United States Patent 11,446,398 (REGULATED BIOCIRCUIT SYSTEMS) - sequence listing, part 50

SEQ ID NO: 141478 - DNA, 8924 bp, Homo sapiens
  Payload ID: 7817
  Gene Symbol: HIVEP1
  Gene Name: human immunodeficiency virus type I enhancer binding protein 1
  ENST ID: ENST00000627968
  CDS Start-End: 6636-8387
gctgctgggcggcggcagggtggcggacggagcgggggaccggggagcggcggccgccggaggaggttatgtttgtgtttggggttgtcaagtgaaggagggatcccaggcgccgccgccgccgccgcgcgggggtcgcggagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttt

SEQ ID NO: 141479 - DNA, 9524 bp, Homo sapiens
  Payload ID: 7818
  Gene Symbol: HIVEP2
  Gene Name: human immunodeficiency virus type I enhancer binding protein 2
  Uniprot ID: P31629
  ENST ID: ENST00000012134
  CDS Start-End: 546-7886
gtggagcctttgaattttttaaaagaccatagtaatcagatctacttgaaaaattaagtgaattgatttggttggaatgctcttttaccgatgctttaacatacagccactaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgctt

SEQ ID NO: 141480 - DNA, 9723 bp, Homo sapiens
  Payload ID: 7818
  Gene Symbol: HIVEP2
  Gene Name: human immunodeficiency virus type I enhancer binding protein 2
  Uniprot ID: P31629
  ENST ID: ENST00000367603
  CDS Start-End: 744-8084
gctggaggcaggaatgtgcctgcttactaatgagcgacgtgcaccggcgcgcacggcccggccaccgctgcggctgcggcggccggcggcggcccgttgtcaggtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttg

SEQ ID NO: 141481 - DNA, 9621 bp, Homo sapiens
  Payload ID: 7818
  Gene Symbol: HIVEP2
  Gene Name: human immunodeficiency virus type I enhancer binding protein 2
  Uniprot ID: P31629
  ENST ID: ENST00000367604
  CDS Start-End: 641-7981
gtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcctgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccacctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggagatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttga

SEQ ID NO: 141482 - DNA, 12110 bp, Homo sapiens
  Payload ID: 7819
  Gene Symbol: HIVEP3
  Gene Name: human immunodeficiency virus type I enhancer binding protein 3
  Uniprot ID: Q5T1R4
  ENST ID: ENST00000247584
  CDS Start-End: 807-8027
ccacaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacagatgcgatcaaggttcctgtttattgccacttcacccccctgcccagctcgtagccacccctctctgccagcagaaaggccagtgtccccaggcagaggggcacaaacacaggcaggtgacccccacccaggccccagcaggcaggcccagaaaaactaatcttttccttttttttttttttttttttttttgcaagaaaataaaatgatacttttcctaggatttcaacacaaaataataggtgcaggtagaaggaggagggctggctccccaagggctcctggatactctggtagtctgagtcatgggcccatcctggcactccacaggtgggcaggccaccccacccacgcacccccactccagacacctcccttctgcaccccaccctggccccctgggctggggaaggagccctgactgtccgtccctggctcccaagcccctgaccgaggcctcactctcctgttgcctcctctgttctaaaaccaccaaaccacccacaaaggcagaagtggcagggcccgagccctagcggccgttcctgagactgggttttgggttttgtttcatcttggtccctggggtacaagggagcctgttcccctcatggctgggtttttccagttctccacagcagaggtttgcggggaactgtttcaggaccactttgccacaggaccgtttccccccgtccctgcccctgtctccactaccccaaggaaatacccacaactgtggctggtggatacggcctggacctgtttgctgtcttacacctcttttttaaaaagagagaggatggtgtttgatacttcacccagccaccacagattcttttgacctagaggatttttgaattgtcctaactcgttggaattctccaaagcaatcagtgtgagccagtgcctcttccttacccacatctctactttcaagaagctgccctgcatttcctggggcaaaactctactttgtaagaaaaataataggaccagaaatttaaatcccaaattgaactatggaacttgaactctagcgtgttcgccccaactgggagaggtgagctttttcccagtgtttcagaactgattttctttactttctacaagggagggcagcacagggactacggttgaggcccgtgaaggctgggtttgatgccaccctatacagagcagggacctctctggctaatccccagtcctcagccaggctgtgtgaatcaagtgcctgccccagggctcttgagctattgaagctgcttgggtacaggacacagtaggtggggagggttaagacccttctgtgagttccctgtgcggggctgtacttgcctcttccaattcgtggcctttccctgcttggtccctactagacagacaaaccagccacagtccagcctgcagccagaccaccttgttcactcattctcctttgcctcagagctaagacaaaaatgagacagaaggcagggctccctgggagtccactgtgctccagggttctggggaatcagggttagccagcagctcctggctgcttccctcagagactagggctctcatcctccccaagagaagcagcaagcccagcctggaccacactgtccatattgctggacagtggcctgacagaaagtgactcctccaagtcccaggaggccagggcttttctcatccttgcctttcagccctaacccatgggactgcccacggattggagacttcaagggctgaggtctgggagctgcataaagggcattgcttcagcccaggttagaaatctgcctgggcaagctcttcctgccccagacctacaaagcagcagaccgggggctctggtggactagcccctgacattggtggggggccccacaccactccaccccaccctgccttccagctctcctgggcatttttctccctgtactcaaacagcctacccacccaaggtttcctccctgggcagcctagcaatgaacagtgcagccggcagggcagaggcccggcagtcaccgggcccgtcaggctcaggcagagaagccacaggggccaggagtcactggagactatttctaaatgatgggggtaaatgcacaaatagaatctcaccaaagggctgcctccacattgatgccgtgcccagagggacagaaccaatgccaccagcctgggtatatgtcactgggcacagctctaaccccctcctccggactctagtcccgctcctctgcgcacagagcccccagcccacaggtacaccttcatgatttggagaaagacgctcgccccatgcacgccctcctctgggccttctgccctgctcccagtcacttccaagcttcctgtttgcctgtgatgttattgtgcctgttgagggaagcagcagaggaggcagtggctgacttggcacagatgcctgctacgtgctctgttgaaatgcgcggggtggccattcctcggtacagactagtcctggtccttgggtgtgggcagtgggggaggaaccaactggtcgaggtttcagagccaaaccttgcctttggttggtgagtccttgccccccaggcctgcgctccacgatgcctttcacccttggcaatctcagggccatcctgggtagtaaccccactcctctctgctcccgcccgcacctgtggctctcactctgggctcaacccctgcaaccctccaggagcccgacagcagccagctgcctgcactgtcgcctccgtaagctccaacttccagacccagaagtccctctgcttccctctgttggaaaaagcctaaaagaattagcttccagattcctctagcccctgctccattcccacccagtccttctgaagaggaatgagcaatacatctgagctggatttctctctagtcctttctccagacaaatccttcttaaagcaaaagtcctggctgagcacctgtccttggggaccgatctgccgtgtgaccaggggaagaaagttcccgaaagcctgttccaccaattctgcttctgtgttgtgaatccagtctgctttccattagaaaaccgcttcggcacttatggtcactttaataaatctagtatgtaaaaaaagaaagaaagaaaagaaacagaaaaaagaaacgtgcaggcaaatgtaaaatacaatgctctctgtaagataaatatttgcctttttttctaaaaggtgtacgtattctgtatgtgaaattgtctgtagaaagtttctatgttcttaaatggcaatacattccaaaaattgtactgtagatatgtacagcaaccgcactgggatggggtagttttgcctgtaattttatttaaactccagtttccacacttgcatcttgcaatgttggtatggtatatatcagtgcaaaagaaaaaacaaaacagaaacaaacaaaaaaaaaaaacaaaaatccacgcaggtctaaagcacagagtctgacgtacaaaaggaaaaatgctcagtattgatgtgtgtgacctttgttgtaaattacatctgtactgtgaatgagaagtttttacaagtataataattgcctttattacagctctggctgagtgttcagcctgaggatattttttaaaaaaaaaagaattagcatgttggaataaatttgaaaatcccaac

SEQ ID NO: 141483 - DNA, 12193 bp, Homo sapiens
  Payload ID: 7819
  Gene Symbol: HIVEP3
  Gene Name: human immunodeficiency virus type I enhancer binding protein 3
  Uniprot ID: Q5T1R4
  ENST ID: ENST00000372583
  CDS Start-End: 887-8107
cctgcctggccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacagatgcgatcaaggttcctgtttattgccacttcacccccctgcccagctcgtagccacccctctctgccagcagaaaggccagtgtccccaggcagaggggcacaaacacaggcaggtgacccccacccaggccccagcaggcaggcccagaaaaactaatcttttccttttttttttttttttttttttttgcaagaaaataaaatgatacttttcctaggatttcaacacaaaataataggtgcaggtagaaggaggagggctggctccccaagggctcctggatactctggtagtctgagtcatgggcccatcctggcactccacaggtgggcaggccaccccacccacgcacccccactccagacacctcccttctgcaccccaccctggccccctgggctggggaaggagccctgactgtccgtccctggctcccaagcccctgaccgaggcctcactctcctgttgcctcctctgttctaaaaccaccaaaccacccacaaaggcagaagtggcagggcccgagccctagcggccgttcctgagactgggttttgggttttgtttcatcttggtccctggggtacaagggagcctgttcccctcatggctgggtttttccagttctccacagcagaggtttgcggggaactgtttcaggaccactttgccacaggaccgtttccccccgtccctgcccctgtctccactaccccaaggaaatacccacaactgtggctggtggatacggcctggacctgtttgctgtcttacacctcttttttaaaaagagagaggatggtgtttgatacttcacccagccaccacagattcttttgacctagaggatttttgaattgtcctaactcgttggaattctccaaagcaatcagtgtgagccagtgcctcttccttacccacatctctactttcaagaagctgccctgcatttcctggggcaaaactctactttgtaagaaaaataataggaccagaaatttaaatcccaaattgaactatggaacttgaactctagcgtgttcgccccaactgggagaggtgagctttttcccagtgtttcagaactgattttctttactttctacaagggagggcagcacagggactacggttgaggcccgtgaaggctgggtttgatgccaccctatacagagcagggacctctctggctaatccccagtcctcagccaggctgtgtgaatcaagtgcctgccccagggctcttgagctattgaagctgcttgggtacaggacacagtaggtggggagggttaagacccttctgtgagttccctgtgcggggctgtacttgcctcttccaattcgtggcctttccctgcttggtccctactagacagacaaaccagccacagtccagcctgcagccagaccaccttgttcactcattctcctttgcctcagagctaagacaaaaatgagacagaaggcagggctccctgggagtccactgtgctccagggttctggggaatcagggttagccagcagctcctggctgcttccctcagagactagggctctcatcctccccaagagaagcagcaagcccagcctggaccacactgtccatattgctggacagtggcctgacagaaagtgactcctccaagtcccaggaggccagggcttttctcatccttgcctttcagccctaacccatgggactgcccacggattggagacttcaagggctgaggtctgggagctgcataaagggcattgcttcagcccaggttagaaatctgcctgggcaagctcttcctgccccagacctacaaagcagcagaccgggggctctggtggactagcccctgacattggtggggggccccacaccactccaccccaccctgccttccagctctcctgggcatttttctccctgtactcaaacagcctacccacccaaggtttcctccctgggcagcctagcaatgaacagtgcagccggcagggcagaggcccggcagtcaccgggcccgtcaggctcaggcagagaagccacaggggccaggagtcactggagactatttctaaatgatgggggtaaatgcacaaatagaatctcaccaaagggctgcctccacattgatgccgtgcccagagggacagaaccaatgccaccagcctgggtatatgtcactgggcacagctctaaccccctcctccggactctagtcccgctcctctgcgcacagagcccccagcccacaggtacaccttcatgatttggagaaagacgctcgccccatgcacgccctcctctgggccttctgccctgctcccagtcacttccaagcttcctgtttgcctgtgatgttattgtgcctgttgagggaagcagcagaggaggcagtggctgacttggcacagatgcctgctacgtgctctgttgaaatgcgcggggtggccattcctcggtacagactagtcctggtccttgggtgtgggcagtgggggaggaaccaactggtcgaggtttcagagccaaaccttgcctttggttggtgagtccttgccccccaggcctgcgctccacgatgcctttcacccttggcaatctcagggccatcctgggtagtaaccccactcctctctgctcccgcccgcacctgtggctctcactctgggctcaacccctgcaaccctccaggagcccgacagcagccagctgcctgcactgtcgcctccgtaagctccaacttccagacccagaagtccctctgcttccctctgttggaaaaagcctaaaagaattagcttccagattcctctagcccctgctccattcccacccagtccttctgaagaggaatgagcaatacatctgagctggatttctctctagtcctttctccagacaaatccttcttaaagcaaaagtcctggctgagcacctgtccttggggaccgatctgccgtgtgaccaggggaagaaagttcccgaaagcctgttccaccaattctgcttctgtgttgtgaatccagtctgctttccattagaaaaccgcttcggcacttatggtcactttaataaatctagtatgtaaaaaaagaaagaaagaaaagaaacagaaaaaagaaacgtgcaggcaaatgtaaaatacaatgctctctgtaagataaatatttgcctttttttctaaaaggtgtacgtattctgtatgtgaaattgtctgtagaaagtttctatgttcttaaatggcaatacattccaaaaattgtactgtagatatgtacagcaaccgcactgggatggggtagttttgcctgtaattttatttaaactccagtttccacacttgcatcttgcaatgttggtatggtatatatcagtgcaaaagaaaaaacaaaacagaaacaaacaaaaaaaaaaaacaaaaatccacgcaggtctaaagcacagagtctgacgtacaaaaggaaaaatgctcagtattgatgtgtgtgacctttgttgtaaattacatctgtactgtgaatgagaagtttttacaagtataataattgcctttattacagctctggctgagtgttcagcctgaggatattttttaaaaaaaaaagaattagcatgttggaataaatttgaaaatcccaacata

SEQ ID NO: 141484 - DNA, 12319 bp, Homo sapiens
  Payload ID: 7819
  Gene Symbol: HIVEP3
  Gene Name: human immunodeficiency virus type I enhancer binding protein 3
  Uniprot ID: Q5T1R4
  ENST ID: ENST00000372584
  CDS Start-End: 1016-8233
ctcacaaccagccgactctcccattatccagctgcctagtttggtgcttcaatgtacatggctattccgtgtgcatatgtgtgtatacaaacacgcatgcatgcctggatggacatacgtatgcacaggttattttttaaggacaattctttcaataaggtctttaccccttacttgaaacaggtgttcatgaaaaaaatgcacaaaatcctgcctggccggaataattcatgaagaaggggctggatccgtgggtcagagaacacaggaccagtttgccatcccaaggccgaaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacagatgcgatcaaggttcctgtttattgccacttcacccccctgcccagctcgtagccacccctctctgccagcagaaaggccagtgtccccaggcagaggggcacaaacacaggcaggtgacccccacccaggccccagcaggcaggcccagaaaaactaatcttttccttttttttttttttttttttttttgcaagaaaataaaatgatacttttcctaggatttcaacacaaaataataggtgcaggtagaaggaggagggctggctccccaagggctcctggatactctggtagtctgagtcatgggcccatcctggcactccacaggtgggcaggccaccccacccacgcacccccactccagacacctcccttctgcaccccaccctggccccctgggctggggaaggagccctgactgtccgtccctggctcccaagcccctgaccgaggcctcactctcctgttgcctcctctgttctaaaaccaccaaaccacccacaaaggcagaagtggcagggcccgagccctagcggccgttcctgagactgggttttgggttttgtttcatcttggtccctggggtacaagggagcctgttcccctcatggctgggtttttccagttctccacagcagaggtttgcggggaactgtttcaggaccactttgccacaggaccgtttccccccgtccctgcccctgtctccactaccccaaggaaatacccacaactgtggctggtggatacggcctggacctgtttgctgtcttacacctcttttttaaaaagagagaggatggtgtttgatacttcacccagccaccacagattcttttgacctagaggatttttgaattgtcctaactcgttggaattctccaaagcaatcagtgtgagccagtgcctcttccttacccacatctctactttcaagaagctgccctgcatttcctggggcaaaactctactttgtaagaaaaataataggaccagaaatttaaatcccaaattgaactatggaacttgaactctagcgtgttcgccccaactgggagaggtgagctttttcccagtgtttcagaactgattttctttactttctacaagggagggcagcacagggactacggttgaggcccgtgaaggctgggtttgatgccaccctatacagagcagggacctctctggctaatccccagtcctcagccaggctgtgtgaatcaagtgcctgccccagggctcttgagctattgaagctgcttgggtacaggacacagtaggtggggagggttaagacccttctgtgagttccctgtgcggggctgtacttgcctcttccaattcgtggcctttccctgcttggtccctactagacagacaaaccagccacagtccagcctgcagccagaccaccttgttcactcattctcctttgcctcagagctaagacaaaaatgagacagaaggcagggctccctgggagtccactgtgctccagggttctggggaatcagggttagccagcagctcctggctgcttccctcagagactagggctctcatcctccccaagagaagcagcaagcccagcctggaccacactgtccatattgctggacagtggcctgacagaaagtgactcctccaagtcccaggaggccagggcttttctcatccttgcctttcagccctaacccatgggactgcccacggattggagacttcaagggctgaggtctgggagctgcataaagggcattgcttcagcccaggttagaaatctgcctgggcaagctcttcctgccccagacctacaaagcagcagaccgggggctctggtggactagcccctgacattggtggggggccccacaccactccaccccaccctgccttccagctctcctgggcatttttctccctgtactcaaacagcctacccacccaaggtttcctccctgggcagcctagcaatgaacagtgcagccggcagggcagaggcccggcagtcaccgggcccgtcaggctcaggcagagaagccacaggggccaggagtcactggagactatttctaaatgatgggggtaaatgcacaaatagaatctcaccaaagggctgcctccacattgatgccgtgcccagagggacagaaccaatgccaccagcctgggtatatgtcactgggcacagctctaaccccctcctccggactctagtcccgctcctctgcgcacagagcccccagcccacaggtacaccttcatgatttggagaaagacgctcgccccatgcacgccctcctctgggccttctgccctgctcccagtcacttccaagcttcctgtttgcctgtgatgttattgtgcctgttgagggaagcagcagaggaggcagtggctgacttggcacagatgcctgctacgtgctctgttgaaatgcgcggggtggccattcctcggtacagactagtcctggtccttgggtgtgggcagtgggggaggaaccaactggtcgaggtttcagagccaaaccttgcctttggttggtgagtccttgccccccaggcctgcgctccacgatgcctttcacccttggcaatctcagggccatcctgggtagtaaccccactcctctctgctcccgcccgcacctgtggctctcactctgggctcaacccctgcaaccctccaggagcccgacagcagccagctgcctgcactgtcgcctccgtaagctccaacttccagacccagaagtccctctgcttccctctgttggaaaaagcctaaaagaattagcttccagattcctctagcccctgctccattcccacccagtccttctgaagaggaatgagcaatacatctgagctggatttctctctagtcctttctccagacaaatccttcttaaagcaaaagtcctggctgagcacctgtccttggggaccgatctgccgtgtgaccaggggaagaaagttcccgaaagcctgttccaccaattctgcttctgtgttgtgaatccagtctgctttccattagaaaaccgcttcggcacttatggtcactttaataaatctagtatgtaaaaaaagaaagaaagaaaagaaacagaaaaaagaaacgtgcaggcaaatgtaaaatacaatgctctctgtaagataaatatttgcctttttttctaaaaggtgtacgtattctgtatgtgaaattgtctgtagaaagtttctatgttcttaaatggcaatacattccaaaaattgtactgtagatatgtacagcaaccgcactgggatggggtagttttgcctgtaattttatttaaactccagtttccacacttgcatcttgcaatgttggtatggtatatatcagtgcaaaagaaaaaacaaaacagaaacaaacaaaaaaaaaaaacaaaaatccacgcaggtctaaagcacagagtctgacgtacaaaaggaaaaatgctcagtattgatgtgtgtgacctttgttgtaaattacatctgtactgtgaatgagaagtttttacaagtataataattgcctttattacagctctggctgagtgttcagcctgaggatattttttaaaaaaaaaagaattagcatgttggaataaatttgaaaatcccaacata

SEQ ID NO: 141485 - DNA, 13474 bp, Homo sapiens
  Payload ID: 7820
  Gene Symbol: HTT
  Gene Name: huntingtin
  Uniprot ID: P42858
  ENST ID: ENST00000355072
  CDS Start-End: 146-9574
gctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatc

SEQ ID NO: 141486 - DNA, 429 bp, Homo sapiens
  Payload ID: 7820
  Gene Symbol: HTT
  Gene Name: huntingtin
  ENST ID: ENST00000509618
  CDS Start-End: 1-337
agagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcggggtaacagttgtggcaagaatgctgtcgttggtggaagcacgaaagagcaagcaggaaatactttgtaaaagaataaaaacgaaaaatgttagcgaa

SEQ ID NO: 141487 - DNA, 8013 bp, Homo sapiens
  Payload ID: 7821
  Gene Symbol: HIP1
  Gene Name: huntingtin interacting protein 1
  Uniprot ID: O00291
  ENST ID: ENST00000336926
  CDS Start-End: 28-3141
gcccctgactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggc

SEQ ID NO: 141488 - DNA, 7066 bp, Homo sapiens
  Payload ID: 7821
  Gene Symbol: HIP1
  Gene Name: huntingtin interacting protein 1
  Uniprot ID: O00291
  ENST ID: ENST00000434438
  CDS Start-End: 22-2982
gactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagagggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctct

SEQ ID NO: 141489 - DNA, 583 bp, Homo sapiens
  Payload ID: 7821
  Gene Symbol: HIP1
  Gene Name: huntingtin interacting protein 1
  ENST ID: ENST00000420909
  CDS Start-End: 146-583
gtaattggctctccggaaccagccggggacacgagggcctgctgggtcaggaagtggtggacaatgccaccctttcaggggagacacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaa

SEQ ID NO: 141490 - DNA, 3120 bp, Homo sapiens
  Payload ID: 7821
  Gene Symbol: HIP1
  Gene Name: huntingtin interacting protein 1
  Uniprot ID: O00291
  ENST ID: ENST00000616821
  CDS Start-End: 5-3031
tcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggag

SEQ ID NO: 141491 - DNA, 4539 bp, Homo sapiens
  Payload ID: 7822
  Gene Symbol: HIP1R
  Gene Name: huntingtin interacting protein 1 related
  Uniprot ID: O75146
  ENST ID: ENST00000253083
  CDS Start-End: 126-3332
ctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctacgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgtttgttgtc

SEQ ID NO: 141492 - DNA, 924 bp, Homo sapiens
  Payload ID: 7822
  Gene Symbol: HIP1R
  Gene Name: huntingtin interacting protein 1 related
  ENST ID: ENST00000535012
  CDS Start-End: 1-593
gacgacatccactagcctgcagaaggagatcgtggagagcggcaggggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacccaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagct

SEQ ID NO: 141493 - DNA, 4777 bp, Homo sapiens
  Payload ID: 7823
  Gene Symbol: HYPK
  Gene Name: huntingtin interacting protein K
  Uniprot ID: Q9NX55
  ENST ID: ENST00000406925
  CDS Start-End: 4112-4501
tctttatcctcacctgaaactcatagctgtaaaccttgacaatccacaggggtccaaatacctcagccaggtaggaggcctcattgctgagaaagaatagagttcttaagctggtttagttaaatagggattatctgggggcatttactaccaattggtccatactggtaatcctcaaaagggtaccatactccctgtgcccttttccaccaaagatttagaattctattcatgtgagagccctaaggtctttggacatattttaaattctcaagtcattccccccacccccttcatctcatacagatcatctgacaaagtactattcttagaatttgtccctgtttgtggggagcttttctcactctagtcttgctctaaactttaaataatggtcccagacattgtcctgaccatccttccctgtcttgggcaccctcctttcatacctccacccttgacacctttacgcaccaagcaaaaagcacacaagcatacatgatgctagcactcagcattgctagagagatatctggtgtttggggttccattttactcaggccaggcaggcacagggtgtgattctgtccttgaaggattactgggaagggacaacagaagagatgggtattaacaatgagctaggtatttggcaggggcaaaaaaaggtcttagcatggagaatccaggtcctgtcccttacctctctctggaggacggctggacagtgcagagaaagtcagatacatgatatagcagctgatgacagaagcttgtaggaggccagagcggggttgctctggggagtaagtataattgctttagtctacaggctggtaatttcctccatttctacccccacttgtacttctgtctccccatcctttggtggggatagggaagcagagattcttttatcaaataattgagattagggaggtaatgaaacttgctatgcttttaaggcccccaaaacctggaatgctgtaggacatgtacccactgaggcggatgcaaggagcgatggagaggaaggagatgaggccacagaagcaaaggtgcagactgaggagcatcttgttaagcaggcagccagctgggtgtgtataatagtggaataggagcacagctcccacacctgccatgctgtagaatcctagggtggccagcaggacagccaggaaccagctacagtcttgagctgcacctgtctgcctaagggtggaaagtgggcaatggcttggagctccagcattttttttttttttgagttgggagtcttgctctgttgcccaggctggagtgcaatggtgtggtctcagctcactgcaacctccgcctcttgggttcaagtgattctcctacctcagcctcctgagtagctgggattacaggcacctaccaccatgtccagctaacttttatatttttactagagatggggtttcaccatgttggccaggctggtctcaaactcctgacctcatgatccacccacctcggcctcccaaagtgctgggattacaggcatgagccaccgtgcccagctggagctccaactcttttacccattaccaactactcccctgctctcagaagactggtgtgactagccatcctacttggcccacgcagtcatcacattcctaagcttttttgatactgctcagtgggaagctgtgggaccagtgctctgccgtgccttttgcccagccctttccatgtagtaatactagaaacctccccaggaaaagcctttagggttatgtgccccttaccagttcttgttccaggaatgggcaaaagctgtaataagcaccaactgcagtaggatgaatgcaaagcctccacagatgccaatgtaatgccatgctgcaagatgggcaccagtggaaaaatgtcaaattgttacttttttttttttttgagacagagtcttgctctgtcacccaggctagagtgcagtggtgtgatttcagctcactgcaacctctgcctcccgggttcaagtgattcttctgcctccacctcctgagcagctgggattacaggtgcgtgccaccatgcccggctaatattttgtatttttagtagagatggggtttcaccatgttagccaggattgtcttgatctcttgacctcgtgatccgcccgcctcagcctcccaaagtgctgggattacaggcgtgagccactgcacccggccattactcctcttcttacccacttgttatcttagaaaacttagcctactcctgccaagagtgtgggagggagagtacctgggaagagatgctcatcaggaatgcagaaggcaatagcacagagacctaacaggaacagcagcttgaggagccagaagctggttaggagggagaaagaaaaacagactcaggagaaaaggcaaaggacagtgaagagtgcctatggggaaaggcaaaagagaaaccaaaaatataggaaagaggacagacgagacaactaaggaggaaccaatcccaaatgagagggggttgggacaggcctactgcaccttattccaaattctaactcaaagatacttaatagcatctgggcaatgttttacagtttataaaggattgtgttaccaagataaccccactgttacctccattttagatgctagaagcacaaagtctggctcaaggttacacagcaagtacacgagaagcagggacttaaacctgttttctgtctttttacagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggtgggcacacaaccccgagggcatctggatctgggagtgtgtgtgagagaaatggcaggacaagtcataatgcatggaaaggtacctacttgtcacgggtatgaccactcatttgtctcctgcccccaaccgaaaccttttctatcttagggtttttccttttatctcttcccacctgacaacccgaccccctctcacttaccctgtgtgtcttgccccacaccctttccactactgtccttgacagcaggaggcagcagattgctgaggcccccacatggaggaggatgtagaacaggcggctgcaagtggatgcggtgagagagggccacctagagtggcagcagctggcacaaggagcaggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcgcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatc

SEQ ID NO: 141494 - DNA, 1712 bp, Homo sapiens
  Payload ID: 7823
  Gene Symbol: HYPK
  Gene Name: huntingtin interacting protein K
  ENST ID: ENST00000458412
  CDS Start-End: 1-249
atgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacgggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacacctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttgaaattggaaagcagaggttgcagtgagctgagatcacactactgtactactgtactccagcctgggggaaagagtgaaactccatctcaaaaaaaaaaaaaaaaaaaaaagcccgggcacagtggctcacacctgtaatcccagcactttgggaggctgaggcagtcggatcatgaggtcaggagttgaagacaagcctggccaacatggtgaaaccctgtctctactaaaaatacaaaaaaaataaaattagccaggcgtggtggtgcatgcctgtagtcccagctactcaggaggctgaagcagaagaattgcttgaaccagggaggcggaagttgcagtgagctgagattgtgccactgtactccagcctgggtgacagagcgagactgtctcaaaaacaaaacaacaaaaaagaatttaggggccaggcatggtggctcatgcctgtaatcccaacaccttgggaagctgaggcaagacgatcacttgagcccagcagtttgagaccagcttgggcaacacagtgagatttcgtctctaccgcgctccccccaccacc

SEQ ID NO: 141495 - DNA, 1051 bp, Homo sapiens
  Payload ID: 7823
  Gene Symbol: HYPK
  Gene Name: huntingtin interacting protein K
  Uniprot ID: Q9NX55
  ENST ID: ENST00000442995
  CDS Start-End: 177-566
agaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctggg

SEQ ID NO: 141496 - DNA, 4564 bp, Homo sapiens
  Payload ID: 7823
  Gene Symbol: HYPK
  Gene Name: huntingtin interacting protein K
  ENST ID: ENST00000620261
  CDS Start-End: 2428-3033
tctttatcctcacctgaaactcatagctgtaaaccttgacaatccacaggggtccaaatacctcagccaggtaggaggcctcattgctgagaaagaatagagttcttaagctggtttagttaaatagggattatctgggggcatttactaccaattggtccatactggtaatcctcaaaagggtaccatactccctgtgcccttttccaccaaagatttagaattctattcatgtgagagccctaaggtctttggacatattttaaattctcaagtcattccccccacccccttcatctcatacagatcatctgacaaagtactattcttagaatttgtccctgtttgtggggagcttttctcactctagtcttgctctaaactttaaataatggtcccagacattgtcctgaccatccttccctgtcttgggcaccctcctttcatacctccacccttgacacctttacgcaccaagcaaaaagcacacaagcatacatgatgctagcactcagcattgctagagagatatctggtgtttggggttccattttactcaggccaggcaggcacagggtgtgattctgtccttgaaggattactgggaagggacaacagaagagatgggtattaacaatgagctaggtatttggcaggggcaaaaaaaggtcttagcatggagaatccaggtcctgtcccttacctctctctggaggacggctggacagtgcagagaaagtcagatacatgatatagcagctgatgacagaagcttgtaggaggccagagcggggttgctctggggagtaagtataattgctttagtctacaggctggtaatttcctccatttctacccccacttgtacttctgtctccccatcctttggtggggatagggaagcagagattcttttatcaaataattgagattagggaggtaatgaaacttgctatgcttttaaggcccccaaaacctggaatgctgtaggacatgtacccactgaggcggatgcaaggagcgatggagaggaaggagatgaggccacagaagcaaaggtgcagactgaggagcatcttgttaagcaggcagccagctgggtgtgtataatagtggaataggagcacagctcccacacctgccatgctgtagaatcctagggtggccagcaggacagccaggaaccagctacagtcttgagctgcacctgtctgcctaagggtggaaagtgggcaatggcttggagctccagcattttttttttttttgagttgggagtcttgctctgttgcccaggctggagtgcaatggtgtggtctcagctcactgcaacctccgcctcttgggttcaagtgattctcctacctcagcctcctgagtagctgggattacaggcacctaccaccatgtccagctaacttttatatttttactagagatggggtttcaccatgttggccaggctggtctcaaactcctgacctcatgatccacccacctcggcctcccaaagtgctgggattacaggcatgagccaccgtgcccagctggagctccaactcttttacccattaccaactactcccctgctctcagaagactggtgtgactagccatcctacttggcccacgcagtcatcacattcctaagcttttttgatactgctcagtgggaagctgtgggaccagtgctctgccgtgccttttgcccagccctttccatgtagtaatactagaaacctccccaggaaaagcctttagggttatgtgccccttaccagttcttgttccaggaatgggcaaaagctgtaataagcaccaactgcagtaggatgaatgcaaagcctccacagatgccaatgtaatgccatgctgcaagatgggcaccagtggaaaaatgtcaaattgttacttttttttttttttgagacagagtcttgctctgtcacccaggctagagtgcagtggtgtgatttcagctcactgcaacctctgcctcccgggttcaagtgattcttctgcctccacctcctgagcagctgggattacaggtgcgtgccaccatgcccggctaatattttgtatttttagtagagatggggtttcaccatgttagccaggattgtcttgatctcttgacctcgtgatccgcccgcctcagcctcccaaagtgctgggattacaggcgtgagccactgcacccggccattactcctcttcttacccacttgttatcttagaaaacttagcctactcctgccaagagtgtgggagggagagtacctgggaagagatgctcatcaggaatgcagaaggcaatagcacagagacctaacaggaacagcagcttgaggagccagaagctggttaggagggagaaagaaaaacagactcaggagaaaaggcaaaggacagtgaagagtgcctatggggaaaggcaaaagagaaaccaaaaatataggaaagaggacagacgagacaactaaggaggaaccaatcccaaatgagagggggttgggacaggcctactgcaccttattccaaattctaactcaaagatacttaatagcatctgggcaatgttttacagtttataaaggattgtgttaccaagataaccccactgttacctccattttagatgctagaagcacaaagtctggctcaaggttacacagcaagtacacgagaagcagggacttaaacctgttttctgtctttttacagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggtgggcacacaaccccgagggcatctggatctgggagtgtgtggagaaatggcaggacaagtcataatgcatggaaaggtacctacttgtcacgggtatgaccactcatttgtctcctgcccccaaccgaaaccttttctatcttagggtttttccttttatctcttcccacctgacaacccgaccccctctcacttaccctgtgtgtcttgccccacaccctttccactactgtccttgacagcaggaggcagcagattgctgaggcccccacatggaggaggatgtagaacaggcggctgcaagtggatgcggtgagagagggccacctagagtggcagcagctggcacaaggagcaggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcgcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttc

SEQ ID NO: 141497 - DNA, 501 bp, Homo sapiens
  Payload ID: 7824
  Gene Symbol: HYPM
  Gene Name: huntingtin interacting protein M
  Uniprot ID: O75409
  ENST ID: ENST00000341016
  CDS Start-End: 24-377
gagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagta

SEQ ID NO: 141498 - DNA, 4087 bp, Homo sapiens
  Payload ID: 7825
  Gene Symbol: HAP1
  Gene Name: huntingtin-associated protein 1
  Uniprot ID: P54257
  ENST ID: ENST00000310778
  CDS Start-End: 11-2026
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagagagcgtgtgggtgggttcccagctgcaggacctgcgggagaagtacatggattgtgggggcatgctgattgagatgcaggaggaggtgaagaccctccgccagcaacccccagtgtccactgggtctgccacccattacccatacagcgtgcctctggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 141499 - DNA, 3931 bp, Homo sapiens
  Payload ID: 7825
  Gene Symbol: HAP1
  Gene Name: huntingtin-associated protein 1
  Uniprot ID: P54257
  ENST ID: ENST00000347901
  CDS Start-End: 11-1870
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatgtatggggctgagactgaaaagttgcagaagcagctggcttcggagaaggaaatccagatgcagctccaggaagaggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 141500 - DNA, 3880 bp, Homo sapiens
  Payload ID: 7825
  Gene Symbol: HAP1
  Gene Name: huntingtin-associated protein 1
  Uniprot ID: P54257
  ENST ID: ENST00000341193
  CDS Start-End: 11-1819
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggaggtgtgtactgccttcctgatccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctg

SEQ ID NO: 141501 - DNA, 5683 bp, Homo sapiens
  Payload ID: 7825
  Gene Symbol: HAP1
  Gene Name: huntingtin-associated protein 1
  Uniprot ID: P54257
  ENST ID: ENST00000393939
  CDS Start-End: 11-1795
cagactcgagatgcgcccgaagaggttgggccggtgctgcgcggggagccggctcggacccggggacccagcagcactcacctgtgcaccttcgccctcagccagtcccgctccggagccctctgcgcagccgcaggcacggggcactggacagagagtaggatcccgagccacctctggatcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaagcactgtgtcctaacctacctccgccagtcaaaaagatcacccaggaagacgtcaaagtgatgttatatttgctggaggagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgatttcgcaggaggcattgctgcaccagcaccactgcccacagctggaagccttgcaggagaagctgaggctgctggaggaggagaatcatcagctgagagaagaggcctctcaactcgacactcttgaggatgaggaacagatgctcattctggagtgtgtggagcagttttcggaggccagccaacagatggctgagctgtcggaggtgctggtgctcaggctggaaaactatgaacggcagcagcaggaggtcgctcggctgcaggcccaggtgctgaagctgcagcagcgctgccggatggagactcttcctggtttccaggagacgctggctgaggagctcagaacgtctctaaggaggatgatctcagaccctgtgtattttatggagaggaattatgagatgcccagaggggacacatccagcctaaggtatgattttcgctacagtgaggatcgagagcaggtgcgggggtttgaggctgaggaagggttgatgctggcagcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacggggccctccctgccgccagccggacaagctgcagatcgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctgcccccaacccctgcctcctctatcccccaggctctccaactctgcagcagtggcagcagcagtcaaaacaaacacggggggcggtgggtgggatggtggagcagcccgggggctgacccaggctggaggacagggccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcaccttccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctccttctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggtctgggccacatggcagcccagggggcaggagaagcccgggagaggcccactggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccgtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggcccagcctccagctgtctctctagggagtgtgtgtgtgcacttggcagggcgaagttgtagagaaagggtggatgctaatattgaagtatgtgccgaggactcctattaaatacgccgtttaatcatagcagcagctcctagagggcggtgggtgatgtcataagtgtctgttggatggagaaactcaggccagagtaggttaagtgatgccctcaccagcagatcatggctagtgtggagctgggatttgagctcatgcttccctgatcctttcaccccagagactgactcagtggcctggctgtgaaagataggatgggagagagtcacccactgtcttagggtgaagtccccagagcagacctggaacagggtttaggaacaagtatagtcgccctccgtatcctcaggctctgcatccgtggagtcaactaaccacagatagaaaatatttgggggaggctgggtgcagtggctcatgcctgtaatcctagcactttgggaggccgaggtgggtggatcatttgaggtcaggagttcgagaccagcctggccaacatggtgaaaccccgtctccactaaaaatacaaaaattagctgggcgtggtggtgggtgcctgtaatcccagctacttgggaggctgaggcaggaggatcacttgaacccaggaggcagaggttgcagtgagcggagatcatgccactgcactccagtctgggcaacaacagcgagactccatttgaaaacacaagaaaatatctgggggaggccaggcgcggtggctcatgcctgtaatcccagcactttgggaggctgaggtgggtggatcacttgaggtcaggagttcgagaccagcctggtcaacatggtgaaaccccgtctctactaaaaatacaaaaaaaattagctgggcatggtggcagcccctgtaatcccagctacttgggaggctgaggtgagaggatcacttgagcttggaaggttgaggttgcagtgagctgaggttgcaccactgtactccaacctgggtgacagagtaagaccctgtctcaaaaaaagagaaaagaaaatgacagacaaaccagacatgggggaaattgccagctttgataaagctttgaaggaaacggagatgcaggagaacaccttgtggaccagagaccactgagcaggagaagcagtgaaatttcctaaaatctggaggattccctgcccctgttatcttcaagtccccagtggtgatgtggaagaaaagcaacctgcaaggtggatgcaagccacaagctgctctgtgaacctgggcacctcacacagatgccactggcctgtgggtctctgaggggacccgcaaatgggactgccaaattctctggtttgctccaggatattatagaaaattatttatatgaatagtaaaaataaaacacactttgtggcccccctgccaaaagaatatcattgagaagattattgctgtggctaaccgggtctcagtcctgctgggaactctgggggacagtagaatatatctcagagtagcctgggtgaggtggctcacacctgtaatcccagcacattgggagggcgaggcaggtggatcacctgaggtcaggagttcgagaccagcctgaccaatggagaaaccccgtctccactaaagatacaaaattaactgggcatggtggcacacatgcctgtaatcccagctactcgggaggctgagacaggagaatcgcttgaatccaggaggtggaggttgcggtgagctgagattgcaccattacaccccagcctgggcaataagagtgaaactccgtctcaagg

SEQ ID NO: 141502 - DNA, 487 bp, Homo sapiens
  Payload ID: 7825
  Gene Symbol: HAP1
  Gene Name: huntingtin-associated protein 1
  ENST ID: ENST00000442364
  CDS Start-End: 1-222
tacagtgaggatcgagagcaggtgcgggggtttgaggctgaggaagggttgatgctggcagcggatatcatgcggggggaagatttcacgcctgcggaggagttcgtgccccaggaggagctgggggctgccaagaagcagctggccaactggcaagatgcccattacaggcggcagctgaggtggaagatgctccagaaagagccccagccgaggacctaagatgggtagagaaaacactttccctcctctacagccctcaggtggcgggtagctcaaggtaatggtgtcaacaggcacaagaacaatgatggaatggagtgagacaccagcaatgcctgcaccagccactcatgagcaattatttacaaatatttattgggttcctcctattcttgccaccggggatacagaagggaggagggacttgtcacgctcccagtttcctgttttgcccgagaggcagacaataaactggcaaacaaaa

SEQ ID NO: 141503 - DNA, 324 bp, Homo sapiens
  Payload ID: 7825
  Gene Symbol: HAP1
  Gene Name: huntingtin-associated protein 1
  ENST ID: ENST00000455021
  CDS Start-End: 1-121
gaattatgagatgcccagaggggacacatccagcctaagagccccagccgaggacctaagatgggtagagaaaacactttccctcctctacagccctcaggtggcgggtagctcaaggtaatggtgtcaacaggcacaagaacaatgatggaatggagtgagacaccagcaatgcctgcaccagccactcatgagcaattatttacaaatatttattgggttcctcctattcttgccaccggggatacagaagggaggagggacttgtcacgctcccagtttcctgttttgcccgagaggcagacaataaactggcaaacaaaa

SEQ ID NO: 141504 - DNA, 601 bp, Homo sapiens
  Payload ID: 7825
  Gene Symbol: HAP1
  Gene Name: huntingtin-associated protein 1
  ENST ID: ENST00000458656
  CDS Start-End: 1-336
gcggatatcatgcggggggaagatttcacgcctgcggaggagttcgtgccccaggaggagctgggggctgccaagaaggtgccggctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaagagccccagccgaggacctaagatgggtagagaaaacactttccctcctctacagccctcaggtggcgggtagctcaaggtaatggtgtcaacaggcacaagaacaatgatggaatggagtgagacaccagcaatgcctgcaccagccactcatgagcaattatttacaaatatttattgggttcctcctattcttgccaccggggatacagaagggaggagggacttgtcacgctcccagtttcctgttttgcccgagaggcagacaataaactggcaaacaaaa

SEQ ID NO: 141505 - DNA, 2935 bp, Homo sapiens
  Payload ID: 7826
  Gene Symbol: HUS1
  Gene Name: HUS1 checkpoint clamp component
  Uniprot ID: O60921
  ENST ID: ENST00000258774
  CDS Start-End: 25-867
gccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaa

SEQ ID NO: 141506 - DNA, 579 bp, Homo sapiens
  Payload ID: 7826
  Gene Symbol: HUS1
  Gene Name: HUS1 checkpoint clamp component
  ENST ID: ENST00000446009
  CDS Start-End: 145-579
acagaggcccgccgcggctgcgccatccgcggccatgaagtttcgggccaagatcgtggacggggcctgtctgaaccacttcacacgtgagcagggaggccggagaggagcgagggaggaacggaaggaagcagaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatg

SEQ ID NO: 141507 - DNA, 1304 bp, Homo sapiens
  Payload ID: 7826
  Gene Symbol: HUS1
  Gene Name: HUS1 checkpoint clamp component
  Uniprot ID: O60921
  ENST ID: ENST00000458191
  CDS Start-End: 156-935
acagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggct

SEQ ID NO: 141508 - DNA, 2121 bp, Homo sapiens
  Payload ID: 7826
  Gene Symbol: HUS1
  Gene Name: HUS1 checkpoint clamp component
  Uniprot ID: O60921
  ENST ID: ENST00000436444
  CDS Start-End: 63-905
ctcagggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggagttggagaccagcctggccaacatggtgaaaccacgtctctact

SEQ ID NO: 141509 - DNA, 1058 bp, Homo sapiens
  Payload ID: 7826
  Gene Symbol: HUS1
  Gene Name: HUS1 checkpoint clamp component
  ENST ID: ENST00000442024
  CDS Start-End: 1-316
tttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttccatccaattaaaagaactgattggttgttggggtgggtagaggagcttcaaaggaaaggagtcccttgtgacctgtggagacagtccccgggcagcaagagcaggagtagaagaggggtgcccgatggtatatgaggggatggcagaagtctggtagcctgggcgtgtggagtttggctcagccatcctcagtcctggtaacccaacagcagccccagacccttctggatttggacatttcattttccaacatgttattgaagcaaacctagatggagaattgaatttgaaaatagaaactgaattagtatgtgttacaactcattttaaagatcttggaaatcctccattaggtaagttttctagtgggttatattttgctttggataagttaattgtttcagataacctacctgttgaggtctcttcatgtaaaaaggttgaaattcagttgactttgtttcatgcttgggtgaagaacaaaggaattgagactggactatgtatccctgtggtgtagtggggcagttagccaccagggggagaagctgtgccaccaagtagctgacagatctgtgcagggtctccatcctctgtagaattcggatcaagttacataacctccaagatcccttccagctattcaattcctgtcctactcctaaagatttctatttctcacctggcatggattcagaaaggtagatacatttgttcttatattctcctccttcagttacttccatatgtatg

SEQ ID NO: 141510 - DNA, 627 bp, Homo sapiens
  Payload ID: 7826
  Gene Symbol: HUS1
  Gene Name: HUS1 checkpoint clamp component
  ENST ID: ENST00000432627
  CDS Start-End: 77-627
aagatcgtggacggggcctgtctgaaccacttcacactaattccttattttaacccctgctttaggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattt

SEQ ID NO: 141511 - DNA, 774 bp, Homo sapiens
  Payload ID: 7826
  Gene Symbol: HUS1
  Gene Name: HUS1 checkpoint clamp component
  ENST ID: ENST00000433977
  CDS Start-End: 91-573
agaaattctgcaaaataagttggtctctaggatacataatgtgcattttagtaattccttattttaacccctgctttaggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgacttgatcttttcctcagccggtcaggagcgatatctggatgtgcacgaaagccaagaagagaagaatttcatggcttagggctaacatggggtaacggtcatgccgatggttaaccctagagctcctgaaagtaaagatgatgccaaagggcccatttcctcttgctcacaatttgtttaagaagaaagtacagaaatatgctgggttagtatttatttaccagtcttgaagactatgaagagtgttgtggaaaaaatgaaaaacatcagcaatcacctt

SEQ ID NO: 141512 - DNA, 1125 bp, Homo sapiens
  Payload ID: 7826
  Gene Symbol: HUS1
  Gene Name: HUS1 checkpoint clamp component
  Uniprot ID: O60921
  ENST ID: ENST00000432325
  CDS Start-End: 156-935
acagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatg

SEQ ID NO: 141513 - DNA, 1025 bp, Homo sapiens
  Payload ID: 7827
  Gene Symbol: HUS1B
  Gene Name: HUS1 checkpoint clamp component B
  Uniprot ID: Q8NHY5
  ENST ID: ENST00000380907
  CDS Start-End: 20-856
ctgccttccctgtggcatcatgaagtttcgcgccaagatcaccggcaaaggctgtctagagctgttcattcacgtcagcggcaccgtcgcgaggctagcgaaggtctgcgtgctccgcgtgcgccctgacagcctgtgcttcggccccgcgggttccggcggcctccacgaggccaggctgtggtgcgaggtgcggcagggggccttccagcagtttcgcatggaaggtgtctcggaagatctcgatgagatccacctggagctgacggcggagcacctgtcccgggcggcgagaagcgcagcgggcgcgtcctccctgaagctgcagctgacccacaagcgccgcccctccctcacggtggcggtggagctggtctcgtccctgggccgcgctcgcagcgtggtgcacgatctgcccgtgcgggtgcttcccaggagagtgtggcgggactgcctgccgcccagcctgcgcgcctccgacgcgagcatccgcctgccgcgctggaggacgctgaggagcatcgtggagaggatggcgaacgtgggcagtcacgtgctggtggaagcaaacctcagtggcaggatgaccctgagtatagagacggaggtggtgtccattcaaagttattttaaaaatcttggaaaccctccccagtcggctgtgggtgtgcctgaaaacagagacctggagagcatggtgcaagtgcgggtggacaatcggaagcttctgcagtttttggagggacagcaaatacatcctacgacggccctgtgcaatatttgggacaatactcttcttcagcttgttttggttcaagaagatgtctctcttcagtatttcattcctgccttgtaaaaattcagccagcttagattttttttttaaggttttgatcttttcaaaactaaaacagaccctgagttaattgggttgaaaatttggaccttcactgacttatgcagggcgtatattttgttgagcccttcctcctttgcaaaatttatattaaagcattggtaaaaca

SEQ ID NO: 141514 - DNA, 5607 bp, Homo sapiens
  Payload ID: 7828
  Gene Symbol: HAPLN1
  Gene Name: hyaluronan and proteoglycan link protein 1
  Uniprot ID: P10915
  ENST ID: ENST00000274341
  CDS Start-End: 852-1916
atccaaggatacaatagcagttgtttgttaagagaaatttaaactcaacaccaatactgagtccagtaaaccagaaaatatgcttctggtgatttgggtggaaggccatctccagtttaagaagctttatgtgccactatcatcattgtctgttatccttgatctcctttggtgaggggaaggcgggaaagagaggacctctccgacccttggatttttcttttaagcagaggctaataaaacaaagcgcaaactgactgtcctgaggagtctgctcacaccgctgccccgcagatcattccacagaccccttgtcccatcccttctggacagacccaggactgatgagggttcgggttcgggaggtgtggtgtggtgggggcttgtgtggctgtagcggccggctttcctaaaccccagagcgggatactcgggatctgagcagaggggaaagtcatctaagaggctgctgctttacaaggtctgggcacagagctgcccctcccttcctccctgaagtttgcatgaagtgcacattaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacgcacacacacacacactctcacactcgcccagagacaaacttaaggtgaggagaaagagcgctagcttcacttgatctccagcttccaacttaagcagaacttgagagcatccgaactcctggatttcaggacaagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtggggggcagaacacagtgcccggagtcaggaactacggattttgggataaagataaaagcagatatgatgttttctgttttacatccaatttcaatggccgtttttactatctgatccaccccaccaaactgacctatgatgaagcggtgcaagcttgtctcaatgatggtgctcagattgcaaaagtgggccagatatttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagttaccaaaactgtgataacccttttttacttactgtaaagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgaccaaaaaaaaaaaaaaaaattcatatggattccaatccatagtaacaagcacagttaaaactcctcaataatcccatttatatgaagcatgacacataaataagcagataatatttaaccaatgaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatgtagattttcctcccatgaacatgagtaaataaatctgtttcctgaatggattgtggttgcatttaaagctctgtaataattctaataaatttactctatagagttctgtgtgtggaaggtatagaacaattggaagtccatgaaaccataactataatcatatattattcagacaaaatattgtaataaaagtaggtcctttctttcatcaaaaacatatctgaaaattttcagatgctttaatattaaaagatgacaatgttatgtatgcacatttttaagttaggttggatatgcaaactgtacaaaactataaatccaaagagtttgtaaagtttaaactcaaacactggtggtataaatagaacttgcacttctaaattaaggaagatacctaaatggtctaggatgagatgatatattatttaaagaggggactatctcccaaataacaactttaacacctcaaatatgggggctagctcattgaaagaagtccatacttgaactattattatgtatgttccgataattttgttgaaaatacaagtgggaacaaatttctattgaagcaaacatctaattttcagttatgtccagaactctactttataatgttaaatgtagtagtatttcttaacttttaaatacttactactataggaattggtgctgatcaaaatctctggagtgactgttagctgattaaaatctataccacttacacatcatttttccattcgtgtaaaaaacaaaaaatcttaacacagtgaatactgctgagcagaattttttcttctcattttgctcaaaggaccagaatttccatgccctttatactcatacttgaatgagtctttttaatgttctcattttgctgtttttccaccaaatgtctattttcctacttcattccccaagatgtctcactgagcaggtctgaaaaagaaaggttattctaatacaattcctaacagaaagttggtacaacactggctaattcagaaatcgctcctcagacttagattccaagagtatcaaagagattagatgggaggctgggccaggaacccttgttttaatgtatttgtccataattaacactggtgaccatataaggaacaaagtatatctgcacatttcactgagacatctacattggaaaacccaaacaaaaagaagcaattcaaataaaaagacaacataagaacgaaaataagttggtcacattaacactggaagccatctttaagtgagtgctgtcatattgtgtcacagtaatttttagccaaatatggcgtttgtaaatttaaactttctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaagaaatatcaacggataactgacatcgttttgttaagaagttaactgtatcgtagctcactactgccagagcggcaatggatgtacaacgaaagagatgaaaaatacaaaagttattaagccacctgattaaaagaaaaccaatatttaaaggcatttaatagatatcaagtataactttgaggagaagaatcaatctgtattaccaaaaaaaaaatgttttgattttctgtaagatacaatgaactggtacattaaaagtcaattttgtgttactgcagtatcttttaattcttctgagttgtagaatcttagctatttttctttgtgtcaaactctgtcaatacattatttccaagaaaggcatttaattcattcttgttctgatacatttgacttcaaattgtaaatacgtacaattttcatttcctagtactcttgcaaagtcaaaaaaaaaaaaagagcatttatatggtgtcgctaaatcaactatagtattatcccaaaatatattgacttttttctctttgtatatgactcaaagcataattaattttgcccaccagttcagcaatcccagaaatctattgtgttgttgattagattaacacattttaaatgctttataacttaatcatgagtgctgaattaaaaaaaggtttttcttttcata

SEQ ID NO: 141515 - DNA, 799 bp, Homo sapiens
  Payload ID: 7828
  Gene Symbol: HAPLN1
  Gene Name: hyaluronan and proteoglycan link protein 1
  ENST ID: ENST00000508307
  CDS Start-End: 203-799
gtggatccgctgactgcagagaccctacctggcactctaagttggtgcgtcagcattttaggttgaaatgaatgaaaaatcaatcaggatgactgcagtggtagcgtgcacaactctaacctagtttgttcataattttcaactattcaccgtagacccaagcagtatgtaagatgtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcgg

SEQ ID NO: 141516 - DNA, 1145 bp, Homo sapiens
  Payload ID: 7828
  Gene Symbol: HAPLN1
  Gene Name: hyaluronan and proteoglycan link protein 1
  ENST ID: ENST00000514416
  CDS Start-End: 241-726
gactgcatgaagtgcattggagagaacagaagtttctgctgctaaaaaccattaatatattatttttatttttattatgacttagtataactaggtaccacagtaaatcgatgatcataaaacttttcattgtatgtagtacaaaatcagaattgacacatatttaaaaatcttcctatgccttctcagagtctggtgactttttaaaatatgttgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtatgtatctataagtcatgttcaacgtataaatggtcattaatagttgctttttttttcatgaagagtaatgtctagtggttaacacagtaataaagtgaaaaaccaaagtccttgcctggcatcttattcttttgtattctacagtctgcctatgattccagctttcatgtttgaaatgcatacacaatgcttatgtgcaaaattgaagctatttgtaactaggagaaacgtgcagtggaactgaattaacagttttcagatactgccttatgttattcaaaatcatctaaattccattatatggttattgagaaattcagactgtgtactttttttattttgtttctaaaattatctcagtttcaaaataatggcatgttttgtaaaggacatctgctaactaaaatatatgtaattgtattctgtaaaa

SEQ ID NO: 141517 - DNA, 823 bp, Homo sapiens
  Payload ID: 7828
  Gene Symbol: HAPLN1
  Gene Name: hyaluronan and proteoglycan link protein 1
  ENST ID: ENST00000504713
  CDS Start-End: 315-823
aataagtgaattaggttctggagtagaggctctcctacaaggacctccaggaacagactcagagctctttaataagtatcccagggagtcaggctttcttggaaaaaacaaattagtgtgagaagccagtactgtgcaatttcagttttaaaaatagccggtattgtcaaggctgctgtgtgcatgagagaaatagaaggtccttgttaattttcgtgtcagcttccacattaaaaccaagaagctccactgaaatccttgcctggcaaatactgcaaaggttataagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgcta

SEQ ID NO: 141518 - DNA, 989 bp, Homo sapiens
  Payload ID: 7828
  Gene Symbol: HAPLN1
  Gene Name: hyaluronan and proteoglycan link protein 1
  ENST ID: ENST00000510978
  CDS Start-End: 215-989
ggtagcaggaattgttcaaagctgccgtcttcggctcttaaaggcagctacagtaactttctgaacagattgggttaaatatttttacagacccattctatgatgataaggcggtaataagttgtgcagtgcaacactccaaagggttccaaatctcacaagcctctttgtatgtgatgctctcgcagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtggggggcagaacacagtgcccggagtcaggaactacggattttgggataaagataaaagcagatatgatgttttctgttttacatccaatttcaatg

SEQ ID NO: 141519 - DNA, 560 bp, Homo sapiens
  Payload ID: 7828
  Gene Symbol: HAPLN1
  Gene Name: hyaluronan and proteoglycan link protein 1
  ENST ID: ENST00000515590
  CDS Start-End: 102-560
ccgaactcctggatttcaggacaagcgccccttctctgattcctgtaaacaagcagagagcacatcacaactctgtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagca

SEQ ID NO: 141520 - DNA, 568 bp, Homo sapiens
  Payload ID: 7828
  Gene Symbol: HAPLN1
  Gene Name: hyaluronan and proteoglycan link protein 1
  ENST ID: ENST00000503117
  CDS Start-End: 22-568
aagattctttgggctataaagatgaagagtctacttcttctggtgctgatttcaatctgctgggctgatcatctttcagacaactatactctggatcatgacagagctattcacatccaagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggacc

SEQ ID NO: 141521 - DNA, 1771 bp, Homo sapiens
  Payload ID: 7829
  Gene Symbol: HAPLN2
  Gene Name: hyaluronan and proteoglycan link protein 2
  Uniprot ID: Q9GZV7
  ENST ID: ENST00000255039
  CDS Start-End: 408-1430
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccggggggagggtgaggcggccgggggcattaactgacctctgagtacagcaataaaataacctggggatcttt

SEQ ID NO: 141522 - DNA, 882 bp, Homo sapiens
  Payload ID: 7829
  Gene Symbol: HAPLN2
  Gene Name: hyaluronan and proteoglycan link protein 2
  ENST ID: ENST00000456112
  CDS Start-End: 327-882
gggggttgtacagaagaggtccggtttcttgaagcagctggaagtcctggatagttcccacctgaaagtctgtttgcaaaggcaatgcgcactcaggcaccagagggcagaggacagaagcttttcctcaaaggtgcaaaaggagcaactgtgttgaacaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccagg

SEQ ID NO: 141523 - DNA, 1980 bp, Homo sapiens
  Payload ID: 7830
  Gene Symbol: HAPLN3
  Gene Name: hyaluronan and proteoglycan link protein 3
  Uniprot ID: Q96S86
  ENST ID: ENST00000359595
  CDS Start-End: 216-1298
aaaggtgcgcgtgttcctttaaggggctggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccatcccca

SEQ ID NO: 141524 - DNA, 3071 bp, Homo sapiens
  Payload ID: 7830
  Gene Symbol: HAPLN3
  Gene Name: hyaluronan and proteoglycan link protein 3
  ENST ID: ENST00000558770
  CDS Start-End: 121-681
cagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggatggggctgtgtgtcctcacatctctcccacatgttagggaggcagttcggggatagaggaaggtgacctgactttagccccagcccgtcccagctatgacatgtgggtaaatgcctcatcccccttagagccctgggcctctcaggtgtaaaatggggtatcacaatctttcctcctttacctccctcagaggcaatgaggataagatgtatgtccttaaaatgcgttctctgtctttgccaccagtgtccacatggcttacatggtggctcagaggggccgcattcctcattcttgaagttggggtggcagtggagttggggagaacctgcaagagtcattggtctggggtctgcaggggcagcctagagaaacagggagccctcaccccattcccggggcttcaagggctaggaatttggggtggaaccaggcatgaaatagtccccctgcaaacacacgtagaggctgcaagctgactgtcagggcccatgggcttctctgccgcccaacctggctttgcccaggtgcctggcttccggccctggtgagatcggaggtttggggctcaggctgttcctgggtccttggccacacggaggagattccaaagtgtccttcccagacccctagggtcacctccactccctaaggtttcattgacttggtagagactacatctcagaagtttaaaaactttttattagagtaaaatttcaaacacgaacatatcttttcagggcctgtggcctctatcagaccctgaccacaaggagagaaaccgcctgccccagacctccctgcccttgagcctcctttatggaaggcccttccccaaccctctccccacggcctctagggcctctccttctcctgaaaatcatctgccacacgtggaaagttccttgcattttcctaggaaatttccacattcataataacgtagacgatcgggtcccagctaacgagtggggagctgggagtcaaacctggcccctagagcccaaagcccgggcctgtctggagaagatggcacagcctcactgggggtctggcgacagccttgcggattaggttggggacattgttggggacattaatggactaattaattaccttaactcatggatgttttctgagtactgctgtgaaccagctgagtcccaggagagaggcggcaacggacaggaggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgcc

SEQ ID NO: 141525 - DNA, 801 bp, Homo sapiens
  Payload ID: 7830
  Gene Symbol: HAPLN3
  Gene Name: hyaluronan and proteoglycan link protein 3
  ENST ID: ENST00000562281
  CDS Start-End: 123-801
atcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcgggctgagtcccaggagagaggcggcaacggacaggaggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcggg

SEQ ID NO: 141526 - DNA, 1547 bp, Homo sapiens
  Payload ID: 7830
  Gene Symbol: HAPLN3
  Gene Name: hyaluronan and proteoglycan link protein 3
  ENST ID: ENST00000562889
  CDS Start-End: 140-1408
gtctggcgggagcgcgggggtttttctgctgccgcttcctttctgcccttttaatttccccgaaatcagactgctgccttggaccgggacagctcgcggcccccgagagctctagccgtcgaggagctgcctggggacgatgaggaaatggaggcacagagaggtgaacttgcccgaagtcactcagcaggatgcagtgtgtccagctccaataccgagcccaggtctgagtgcccagacaggactccagaagatttggggaactatccactgccaagtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactatt

SEQ ID NO: 141527 - DNA, 3449 bp, Homo sapiens
  Payload ID: 7831
  Gene Symbol: HAPLN4
  Gene Name: hyaluronan and proteoglycan link protein 4
  Uniprot ID: Q86UW8
  ENST ID: ENST00000291481
  CDS Start-End: 65-1273
ccgggtgtgcggggagcgcagtccgggtgcgtaggggccgctcggcgggggccgcgcgggcaagatggtgtgcgctcgggcggccctcggtcccggcgcgctctgggccgcggcctggggcgtcctgctgctcacagcccctgcgggggcgcagcgtggccggaagaaggtcgtgcacgtgctggagggtgagtcgggctcggtagtggtacagacagcgcctgggcaggtggtaagccaccgtggtggcaccatcgtcttgccctgccgctaccactatgaggcagccgcccacggtcacgacggcgtccggctcaagtggacaaaggtggtggacccgctggccttcaccgacgtcttcgtggcactaggcccccagcaccgggcattcggcagctaccgtgggcgggctgagctgcagggcgacgggcctggggatgcctccctggtcctccgcaacgtcacgctgcaagactacgggcgctatgagtgcgaagtcaccaatgagctggaagatgacgctggcatggtcaagctggacctggaaggcgtggtctttccctaccacccccgtggaggccgatacaagctgaccttcgcggaggcgcagcgcgcgtgcgccgagcaggacggcatcctggcatctgcagaacagctgcacgcggcctggcgcgacggcctggactggtgcaacgcgggctggttgcgcgacggctcagtgcaataccccgtgaaccggccccgggagccctgcggcggcctgggggggaccgggagtgcagggggcggcggtgatgccaacgggggcctgcgcaactacgggtatcgccataacgccgaggaacgctacgacgccttctgcttcacgtccaacctgccggggcgcgtgttcttcctgaagccgctgcgacctgtacccttctccggagctgcgcgcgcgtgtgctgcgcgtggcgcggccgtggccaaggtggggcagctgttcgccgcgtggaagctgcagctgctagaccgctgcaccgcgggttggctggccgatggcagtgcgcgctaccccatcgtgaacccgcgagcgcgctgcggaggccgcaggcctggtgtgcgcagcctcggcttcccggacgccacccgacggctcttcggcgtctactgctaccgcgctccaggagcaccggacccggcacctggcggctggggctggggctgggcgggcggcggcggctgggcagggggcgcgcgcgatcctgctgcctggacccctctgcacgtctaggctgggagtaggcggacagccagggcgcttgaccactggtctagagccctgtggtcccctggagcctggccacgcccttgaagccctggacactggccacattccctgtggtcccttacaaactaactgtgcccctggggtccctgaagactggctagtcctggcagaacagtactttggagttccctggagcctggccagccctcacctcttctggatagaggattcccccaactccccaactttctccatgagggtcacgccccctgaggacctcaggaggccagcagaacccgcaggctcctgaagactggccacgcctcctgagaccacttggaaacagaccaactgcccccgtggtcgcctggtggctggacccccgggattgactagagaccggccgtacaccttctgcatctcactggagactgaacactagtcccttgcggtcacgtgggacactgggcgcctcctcctccccctcctcctcacctggagagactacaggaacttcagggtcactccccgtggtcacatggaggttgtgggccgaggcgcttattttcccttatggtgacctgagtcctggagactcccattctccccctctccctgagagtcccctgcagtttctgggtaacagggcacacccctctagtttcatgggcgagcacccccatctgccacctcagactgacacacagccagctggctcacttactgggggccacgtcccacccctcagatatttctttgaagggagagcaaacccaccctgtcctctgacgtccctttcccaactgtcaccaaacagaccatcttcccaggcctggggaccggtaagatccatgtcactagttatgcagagcagttgccttgggtcccactgtcaccaaggcaaccagtcctgctgctacctgtcacctagagtcacacaccccttccctcatcaggcacacccatgaagacagtgcctccctcctccagctgtaaccatggataccacacatttctcatctcattggcccccaccccagagacctccacctcaacttctggctgtccctaccctgactcaccgccatggagatcaccctccccgaagctgtcgccagggtgacccaacatccagttctccggctctcaccatggaaacaaactgtccctgtccccaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttgccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgtttcttttgatgaatgagaaaa

SEQ ID NO: 141528 - DNA, 3009 bp, Homo sapiens
  Payload ID: 7832
  Gene Symbol: HABP2
  Gene Name: hyaluronan binding protein 2
  Uniprot ID: Q14520
  ENST ID: ENST00000351270
  CDS Start-End: 97-1779
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggacatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaag

SEQ ID NO: 141529 - DNA, 2972 bp, Homo sapiens
  Payload ID: 7832
  Gene Symbol: HABP2
  Gene Name: hyaluronan binding protein 2
  Uniprot ID: Q14520
  ENST ID: ENST00000542051
  CDS Start-End: 135-1739
catagaaaccactaacgaaaattaactgtttactttttcactgtctgcccatctcctcctcaaccagttcacatctgcctccttcatccccacatcaccaatgcctggctcacagcagagcttctttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggacatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaa

SEQ ID NO: 141530 - DNA, 2615 bp, Homo sapiens
  Payload ID: 7833
  Gene Symbol: HABP4
  Gene Name: hyaluronan binding protein 4
  Uniprot ID: Q5JVS0
  ENST ID: ENST00000375249
  CDS Start-End: 76-1317
tgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacttaaccaatcatttaaaaatcgctattgtgtagccactggccaccactctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctga

SEQ ID NO: 141531 - DNA, 2304 bp, Homo sapiens
  Payload ID: 7833
  Gene Symbol: HABP4
  Gene Name: hyaluronan binding protein 4
  Uniprot ID: Q5JVS0
  ENST ID: ENST00000375251
  CDS Start-End: 80-1006
ggcatgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaaagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtgatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttactgtttacttgtaaatgttatcttctctcctggaatattttgagttctggttttcacttaaccaatcatttaaaaatcgctattgtgtagccactggccaccactctgtgacacagaatcagagaaagcgttgatttttaatggtgatttaaactacctcgtggtttctgtgtgtgtgcacacacacatctagtgtttgggtggtttttaggaagaatattaagtatgtgacttcaaaaaccatgttatttaacctgccaatcaaatggaaagggatcatggcaaaagcaaataccgcatccttttcttccgcagaactagagtcagagttcggcagctgcgtacaaaggcctctgccctcggcttgagcaaaagttgtaaataactagtatttattaagcacttataagcagtttttctcacttagtcctggctccagttctagagttcctctttattgcttttggtgaaagtttggggttgggggtacacctcagaggttcagtaattcacctggagtcccaccctgaacagagctggacccagagccacacacgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcctga

SEQ ID NO: 141532 - DNA, 2087 bp, Homo sapiens
  Payload ID: 7834
  Gene Symbol: HAS1
  Gene Name: hyaluronan synthase 1
  Uniprot ID: Q92839
  ENST ID: ENST00000222115
  CDS Start-End: 36-1772
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttc

SEQ ID NO: 141533 - DNA, 2110 bp, Homo sapiens
  Payload ID: 7834
  Gene Symbol: HAS1
  Gene Name: hyaluronan synthase 1
  ENST ID: ENST00000540069
  CDS Start-End: 62-1795
gccacagagaggctgggagagcaagccggagagaagagagagcccggccagacccactgcgatgagacaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttc

SEQ ID NO: 141534 - DNA, 760 bp, Homo sapiens
  Payload ID: 7834
  Gene Symbol: HAS1
  Gene Name: hyaluronan synthase 1
  ENST ID: ENST00000594621
  CDS Start-End: 1-645
atgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctagaatcctgcccaggccccagggagcacgcgatgatgccctcattcctcgcccccgtgcaggtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctac

SEQ ID NO: 141535 - DNA, 654 bp, Homo sapiens
  Payload ID: 7834
  Gene Symbol: HAS1
  Gene Name: hyaluronan synthase 1
  ENST ID: ENST00000601667
  CDS Start-End: 1-421
gcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtaagctgaggggaccaggtggtcgggtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctac

SEQ ID NO: 141536 - DNA, 2086 bp, Homo sapiens
  Payload ID: 7834
  Gene Symbol: HAS1
  Gene Name: hyaluronan synthase 1
  ENST ID: ENST00000601714
  CDS Start-End: 14-1771
gcgcccgggactcatgccccttcctttcccctctcgctcccagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttc

SEQ ID NO: 141537 - DNA, 4190 bp, Homo sapiens
  Payload ID: 7835
  Gene Symbol: HAS2
  Gene Name: hyaluronan synthase 2
  Uniprot ID: Q92819
  ENST ID: ENST00000303924
  CDS Start-End: 539-2197
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtttatcaaaggttttgttctgtggcctgaatttactgggtcctacctacacattgaacatgttttgcctgtcttttttttttttttcaacttgccagttcactttacatgttagtataatgtttacacgggtgagttggataaattataaaacatataaattcaaaattggcagatagaatcaccaagtatctatcctcttttactttcaaatgaggaattttgtttttctgaattacacagatcatcacttcctatttcctgttctggacctgtataaaaatgtctacacagtagaagtgacatcaaggtttaataagtatatcaatgattggcacatataaaaattgttgaaccacatactctgaacttggctaatttagttactgcaaggcctccattatccagttttattttttacacgattgaccttgccttgtagctggtgctgtgtagacctgtgttgaaaacacaatcggaatatatgaataattgaataaacagcattatggtgaggcagagacacatggagaagtgttaaaaaaaaaatgggcttcctgcctttctgcctcttttttatgcagtcatctatgttacatctatcctgcctaagaaaaagctgcacatcctaccttcagagtacaaaaaggtacatctgagactcaagactctcactgattggagagcttgtggaaaacaaaacacaccatgccaataaatgagatgaaaacttgagtttgcctttttaactatttatgttctaagttaagctttgataacattcaaatgtcaaattctctcattcttataaaaagttgaattaattgcctgtatttattttagcaattattcaatgtatttccagtataggatgtatagtataattaattttttgtaaataaaatatttttgataaga

SEQ ID NO: 141538 - DNA, 1163 bp, Homo sapiens
  Payload ID: 7836
  Gene Symbol: HAS3
  Gene Name: hyaluronan synthase 3
  Uniprot ID: O00219
  ENST ID: ENST00000219322
  CDS Start-End: 61-906
ggaggggcatggagccgccgcgggcctgctgagctccggagcgcggcagccggcggcacgatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagcccccagggaaaggtatggcagtagaggatgaccaggtccaagctgcccaggtcagagctacggaagcatggtccgttcaccaacgccacgtttctagagagcagtgagctgattctccaatggtgagcaggggactacatgtgaactgggacctgcaggccaatgtatccctgaggaaaagtccacaagaacaattcaagaaactagtaagaaacaatgggcagaaagctgtgggacgaaagcacagcaggcttctgggaggctggagatcctttctctcaagggcaggattattcccacctgccacagttcacatgccacaaataacatctcaccttcagtcaagaaaaacgcaaaggaaaaa

SEQ ID NO: 141539 - DNA, 4220 bp, Homo sapiens
  Payload ID: 7836
  Gene Symbol: HAS3
  Gene Name: hyaluronan synthase 3
  Uniprot ID: O00219
  ENST ID: ENST00000306560
  CDS Start-End: 157-1818
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 141540 - DNA, 2170 bp, Homo sapiens
  Payload ID: 7836
  Gene Symbol: HAS3
  Gene Name: hyaluronan synthase 3
  Uniprot ID: O00219
  ENST ID: ENST00000569188
  CDS Start-End: 225-1886
cttaaagtcatcagcgccccactgcggaattcaaagctaagctgtcacaattgttaacaccttctttgaccagcctttttacatttgacaattctcttcagcgcctctttcctgccagcaggaaggttttgctgccttggctttcgggagccccctagacagcgaactgccccttcgcgtgcagaagtcggggaagagtgctctcagctcgccttccttgcaggatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctcc

SEQ ID NO: 141541 - DNA, 900 bp, Homo sapiens
  Payload ID: 7836
  Gene Symbol: HAS3
  Gene Name: hyaluronan synthase 3
  ENST ID: ENST00000566118
  CDS Start-End: 108-900
aatgaattaggaggcggacgccggtgcggggctccaggctggctggggtacccctcccccgcaccttctacgacctcccgggggtttgcacctgtccgggcaccaagatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactgga

SEQ ID NO: 141542 - DNA, 2872 bp, Homo sapiens
  Payload ID: 7837
  Gene Symbol: HMMR
  Gene Name: hyaluronan-mediated motility receptor (RHAMM)
  Uniprot ID: O75330
  ENST ID: ENST00000353866
  CDS Start-End: 328-2457
gggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctacttt

SEQ ID NO: 141543 - DNA, 2988 bp, Homo sapiens
  Payload ID: 7837
  Gene Symbol: HMMR
  Gene Name: hyaluronan-mediated motility receptor (RHAMM)
  Uniprot ID: O75330
  ENST ID: ENST00000358715
  CDS Start-End: 37-2211
gccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaa

SEQ ID NO: 141544 - DNA, 3102 bp, Homo sapiens
  Payload ID: 7837
  Gene Symbol: HMMR
  Gene Name: hyaluronan-mediated motility receptor (RHAMM)
  Uniprot ID: O75330
  ENST ID: ENST00000393915
  CDS Start-End: 144-2321
ggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaattaa

SEQ ID NO: 141545 - DNA, 2084 bp, Homo sapiens
  Payload ID: 7837
  Gene Symbol: HMMR
  Gene Name: hyaluronan-mediated motility receptor (RHAMM)
  Uniprot ID: O75330
  ENST ID: ENST00000432118
  CDS Start-End: 94-2010
tccgcattcagttgtcgaggagtgccagtcaccttcagtttctggagctggccgtcaacatgtcctttcctaaggcgcccttgaaacgattcaatgacccttctgattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacat

SEQ ID NO: 141546 - DNA, 609 bp, Homo sapiens
  Payload ID: 7837
  Gene Symbol: HMMR
  Gene Name: hyaluronan-mediated motility receptor (RHAMM)
  ENST ID: ENST00000522094
  CDS Start-End: 333-609
aatgcactttctaacgtctccggagggaagtgcgcttgcgcaaatgctaggttacacttgagtaactccgggaatgactgggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaag

SEQ ID NO: 141547 - DNA, 720 bp, Homo sapiens
  Payload ID: 7837
  Gene Symbol: HMMR
  Gene Name: hyaluronan-mediated motility receptor (RHAMM)
  ENST ID: ENST00000520345
  CDS Start-End: 416-720
tttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggaggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaact

SEQ ID NO: 141548 - DNA, 2517 bp, Homo sapiens
  Payload ID: 7838
  Gene Symbol: HYAL1
  Gene Name: hyaluronoglucosaminidase 1
  Uniprot ID: Q12794
  ENST ID: ENST00000266031
  CDS Start-End: 617-1924
ttcctccaggagtctctggtgcagctggggtggaatctggccaggccctgcttaggcccccatcctggggtcaggaaatttggaggataaggcccttcagccccaaggtcagcagggacgagcgggcagactggcgggtgtacaggagggctgggttgacctgtccttggtcactgaggccattggatcttcctccagtggctgccaggatttctggtggaagagacaggaaggcctcccccccttggtcgggtcagcctgggggctgagggcctggctgtcagccactcttcccagaacatatgtcatggcctcagtggctcatggggaagcaggggtgggcgagcttaggctagagcaagtcctgtgggagatggcagaggcctggtctgagaggcaactcggatgtgccctccagtggccatgctcccctccatgcgtctcccctgccctcctggagccctgcaggtcaatgtttaacagaaaccagagcagcggtggattaatgcgcaagggctcagccccccagccctgagcagtgggggaatcggagactttgcaacctgttctcagctctgcctcccctggccaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactt

SEQ ID NO: 141549 - DNA, 2324 bp, Homo sapiens
  Payload ID: 7838
  Gene Symbol: HYAL1
  Gene Name: hyaluronoglucosaminidase 1
  Uniprot ID: Q12794
  ENST ID: ENST00000320295
  CDS Start-End: 428-1735
agatgtggggagcgcctctgccctgtcgccccgtccgggatgtgaggagcgtctctccctggccgccccgtctgagaagtgaggagcccctccgcccagcagccgccctgtctgagaagctagtcttgaattcctgacctcaggtgatcctcccgcgttggcctcccaaagtgctgggattacaggcatgagccaccactcctggccccagaaagtgacattctttacttaccacaggaggaaaagatccacgaaagtaaagtgcctagggcccatcaatgtcagatgcagccacgtggacaaagaacactccctgagcacaagacacgaaagaacccggtctccagtgtcacaaacaggcctgcccagcagggtctgcccctgcccacctcctccagcctaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgattt

SEQ ID NO: 141550 - DNA, 1522 bp, Homo sapiens
  Payload ID: 7838
  Gene Symbol: HYAL1
  Gene Name: hyaluronoglucosaminidase 1
  Uniprot ID: Q12794
  ENST ID: ENST00000395143
  CDS Start-End: 133-1350
cttcctccaggagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatag

SEQ ID NO: 141551 - DNA, 2081 bp, Homo sapiens
  Payload ID: 7838
  Gene Symbol: HYAL1
  Gene Name: hyaluronoglucosaminidase 1
  Uniprot ID: Q12794
  ENST ID: ENST00000395144
  CDS Start-End: 180-1487
gggtggggtgaccccctacaaaagctcagaatttccagcagcggctccttcctccaggagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactta

SEQ ID NO: 141552 - DNA, 666 bp, Homo sapiens
  Payload ID: 7838
  Gene Symbol: HYAL1
  Gene Name: hyaluronoglucosaminidase 1
  Uniprot ID: Q12794
  ENST ID: ENST00000447605
  CDS Start-End: 135-665
cttcctccaggagtctctggtgcagctggggtggaatctggccaggccctgcttaggcccccatcctggggtcaggaaatttggaggataaggcccttcagccccaagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgat

SEQ ID NO: 141553 - DNA, 561 bp, Homo sapiens
  Payload ID: 7838
  Gene Symbol: HYAL1
  Gene Name: hyaluronoglucosaminidase 1
  ENST ID: ENST00000452672
  CDS Start-End: 354-561
tttttgtatttttagtagagaaggggtttcaccatgttagccgggatggtctcgatctcctgacctcgtgatctgccacctcggcttcccaaagtgctaggattataggcgtgagcctccgcacctggcatgcctggccatattttaaaatattttttttaaggaggaaaagatccacgaaagtaaagtgcctagggcccatcaatgtcagatgcagccacgtggacaaagaacactccctgagcacaagacacgaaagaacccggtctccagtgtcacaaacaggcctgcccagcagggtctgcccctgcccacctcctccagcctaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctg

SEQ ID NO: 141554 - DNA, 1084 bp, Homo sapiens
  Payload ID: 7838
  Gene Symbol: HYAL1
  Gene Name: hyaluronoglucosaminidase 1
  Uniprot ID: Q12794
  ENST ID: ENST00000457214
  CDS Start-End: 322-1083
cttcctccaggagtctctggtgcagctggggtggaatctggccaggccctgcttaggcccccatcctggggtcaggaaatttggaggataaggcccttcagccccaaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgat

SEQ ID NO: 141555 - DNA, 567 bp, Homo sapiens
  Payload ID: 7838
  Gene Symbol: HYAL1
  Gene Name: hyaluronoglucosaminidase 1
  ENST ID: ENST00000418723
  CDS Start-End: 258-567
ccttcctccaggagtctctggtgcagctggggtggaatctggccaggccctgcttaggcccccatcctggggtcaggaaatttggaggataaggcccttcagccccaaggtcaatgtttaacagaaaccagagcagcggtggattaatgcgcaagggctcagccccccagccctgagcagtgggggaatcggagactttgcaacctgttctcagctctgcctcccctggccaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattg

SEQ ID NO: 141556 - DNA, 2225 bp, Homo sapiens
  Payload ID: 7838
  Gene Symbol: HYAL1
  Gene Name: hyaluronoglucosaminidase 1
  Uniprot ID: Q12794
  ENST ID: ENST00000618175
  CDS Start-End: 325-1632
caccatgttagccgggatggtctcgatctcctgacctcgtgatctgccacctcggcttcccaaagtgctaggattataggcgtgagcctccgcacctggcatgcctggccatattttaaaatattttttttaaggaggaaaagatccacgaaagtaaagtgcctagggcccatcaatgtcagatgcagccacgtggacaaagaacactccctgagcacaagacacgaaagaacccggtctccagtgtcacaaacaggcctgcccagcagggtctgcccctgcccacctcctccagcctaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactt

SEQ ID NO: 141557 - DNA, 2055 bp, Homo sapiens
  Payload ID: 7839
  Gene Symbol: HYAL2
  Gene Name: hyaluronoglucosaminidase 2
  Uniprot ID: Q12891
  ENST ID: ENST00000357750
  CDS Start-End: 301-1722
attctggagggaaacagggtcaaggcgatctcctcccccacgcctgttcctggccctttcctctcagggggcagcaggaagtgaggagaaagggctgggatgggaggcgggagcggatgggagggaatggggtttatcaagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgcttgga

SEQ ID NO: 141558 - DNA, 2136 bp, Homo sapiens
  Payload ID: 7839
  Gene Symbol: HYAL2
  Gene Name: hyaluronoglucosaminidase 2
  Uniprot ID: Q12891
  ENST ID: ENST00000395139
  CDS Start-End: 395-1816
atttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgc

SEQ ID NO: 141559 - DNA, 550 bp, Homo sapiens
  Payload ID: 7839
  Gene Symbol: HYAL2
  Gene Name: hyaluronoglucosaminidase 2
  ENST ID: ENST00000424190
  CDS Start-End: 198-550
ctcccggcagcgttccttccagtttcgtagcctcttgacgagctgttccctgctttacccaaatgctgtcgtttctctggatcaagggttcttcacggtgtacagggtgggcatcagctgttcagggttctctgaaaccatgtactggatgttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtgga

SEQ ID NO: 141560 - DNA, 745 bp, Homo sapiens
  Payload ID: 7839
  Gene Symbol: HYAL2
  Gene Name: hyaluronoglucosaminidase 2
  ENST ID: ENST00000458018
  CDS Start-End: 383-745
acaaagacccggcggagcgcgctctagccctgagcggccgggcgggggaggcgagcgcgcgcattcccggtggcggtggagggaagggccgggcggccggcgccgccgtgggaggtccgctgcccctttgtccctacggggcctcctccaagccgggagagtgtcagcgctcgagagaaagtccggagagcctcactcttctgccgggcgagtgttacacggatagaagcctcccggcagcgttccttccagtttcgtagcctcttgacgagctgttccctgctttacccaaatgctgtcgtttctctggatcaagggttcttcacggtgtacaggttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacatt

SEQ ID NO: 141561 - DNA, 4054 bp, Homo sapiens
  Payload ID: 7839
  Gene Symbol: HYAL2
  Gene Name: hyaluronoglucosaminidase 2
  Uniprot ID: Q12891
  ENST ID: ENST00000447092
  CDS Start-End: 2294-3715
gaatggggtttatcaagtcctcggcgagctgcccaacgggcagcagctggcgcaagtagcctagctggagaggctcaccccaggaaggagggaggccaccgacctactgggccgacggactcccacacaggtgagcccagagcagacggctggtctgcacccccacagatgcgctcgcagttgcactccctccctctcctggcgcccgggagggttaggggctggtggtgcagacgcgggcccttttgggagttgagtctcgcacaagggagcggacctaggaagagccgaggtggtttcgcacggggctcgccagggtctaagcctgccccccaccgggagaggcctgtggagcgtagggggcgctggatacgggatggaggccctgggagacccctcttgctggctttctcggaggtccagccagaaactgctgcaaggaatggaggcctcctcggggttgagagggagccgggctcccaaaggacctcagagactgggcagaaaaggacgggatctcagggatgactgtcccgccctgatgcgagtcagggagaggggcggccaacctcctagacccctctgagcttccctgaccccaaccctgcggccacgccgcgacccagagccgggctgccaggataacgactgcctcggcccttcctgggccggctaagaagcggtgcttggccccttccctcagtctggcagggggcggggcctccctttagacggcggaccagagaagggggcccctgattcgtgggaggcggggcactactctccaggagaccagaggtcgcctcaggtcaaagtccctttttccacacaaaggggacccacggctggcgtctacgttagggggtgcagagccagatctggtgctgccccctgccaacctcggagtaccacagcacctcctgatggccgaacggggcaacgcctcctcctattcccccccccccccttcccgtccccctgccttgtccctcacactgtctctttaaagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgaggtgagggcgggcggtgcaaacctggcggctctctccccttgggctggggtctgaatccccgggggtgctcgcggagaggcgtcccagaaaccccacccccacccgaccgggcgcaggccccacgtgtggggcgggggcggggtcccgcacaaagacccggcggagcgcgctctagccctgagcggccgggcgggggaggcgagcgcgcgcattcccggtggcggtggagggaagggccgggcggccggcgccgccgtgggaggtccgctgcccctttgtccctacggggcctcctccaagccgggagagtgtcagcgctcgagagaaagtccggagagcctcactcttctgccgggcgagtgttacacggatagaagcctcccggcagcgttccttccagtttcgtagcctcttgacgagctgttccctgctttacccaaatgctgtcgtttctctggatcaagggttcttcacggtgtacagggtgggcatcagctgttcagggttctctgaaaccatgtactggatggtatgcaggcatatatgtgactctggtgagcccaaattatctagttcttagaagggtcacagacctaatagagatttgtgccgagccacaggctacctgctccagaaaagagccctgtgcttctggcagtgagttcccagggtgccttgtctgccctgcagtggcctgtggtctctcaaacctattacagccatgagcacagtgcccccacacagcatgggctttgggagcatagatgggcttgaggtgggcacttccagtattccctagactgacttgttctccccaacccttcttccagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgcttggattttgt

SEQ ID NO: 141562 - DNA, 301 bp, Homo sapiens
  Payload ID: 7839
  Gene Symbol: HYAL2
  Gene Name: hyaluronoglucosaminidase 2
  ENST ID: ENST00000415028
  CDS Start-End: 159-301
ggtggcggtggagggaagggccgggcggccggcgccgccgtgggaggtccgctgcccctttgtccctacggggcctcctccaagccgggagagtgtcagcgctcgagagaaattcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtgg

SEQ ID NO: 141563 - DNA, 2318 bp, Homo sapiens
  Payload ID: 7839
  Gene Symbol: HYAL2
  Gene Name: hyaluronoglucosaminidase 2
  Uniprot ID: Q12891
  ENST ID: ENST00000442581
  CDS Start-End: 580-2001
gggtttatcaagtcctcggcgagctgcccaacgggcagcagctggcgcaagtagcctagctggagaggctcaccccaggaaggagggaggccaccgacctactgggccgacggactcccacacagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaat

SEQ ID NO: 141564 - DNA, 357 bp, Homo sapiens
  Payload ID: 7839
  Gene Symbol: HYAL2
  Gene Name: hyaluronoglucosaminidase 2
  ENST ID: ENST00000426286
  CDS Start-End: 114-357
gagctgttccctgctttacccaaatgctgtcgtttctctggatcaagggttcttcacggtgtacaggttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgacc

SEQ ID NO: 141565 - DNA, 571 bp, Homo sapiens
  Payload ID: 7839
  Gene Symbol: HYAL2
  Gene Name: hyaluronoglucosaminidase 2
  ENST ID: ENST00000428028
  CDS Start-End: 342-571
agcagctggcgcaagtagcctagctggagaggctcaccccaggaaggagggaggccaccgacctactgggccgacggactcccacacagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccat

SEQ ID NO: 141566 - DNA, 1942 bp, Homo sapiens
  Payload ID: 7840
  Gene Symbol: HYAL3
  Gene Name: hyaluronoglucosaminidase 3
  Uniprot ID: O43820
  ENST ID: ENST00000336307
  CDS Start-End: 274-1527
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgc

SEQ ID NO: 141567 - DNA, 1635 bp, Homo sapiens
  Payload ID: 7840
  Gene Symbol: HYAL3
  Gene Name: hyaluronoglucosaminidase 3
  Uniprot ID: O43820
  ENST ID: ENST00000359051
  CDS Start-End: 57-1220
gaccaaagggtgcggctgctgcagaggtggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgc

SEQ ID NO: 141568 - DNA, 545 bp, Homo sapiens
  Payload ID: 7840
  Gene Symbol: HYAL3
  Gene Name: hyaluronoglucosaminidase 3
  ENST ID: ENST00000435141
  CDS Start-End: 67-545
aaaaggcccaagagacccctggggaaacatgctttccccagctcctcctgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacct

SEQ ID NO: 141569 - DNA, 1402 bp, Homo sapiens
  Payload ID: 7840
  Gene Symbol: HYAL3
  Gene Name: hyaluronoglucosaminidase 3
  Uniprot ID: O43820
  ENST ID: ENST00000450982
  CDS Start-End: 38-1201
ccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtc

SEQ ID NO: 141570 - DNA, 959 bp, Homo sapiens
  Payload ID: 7840
  Gene Symbol: HYAL3
  Gene Name: hyaluronoglucosaminidase 3
  Uniprot ID: O43820
  ENST ID: ENST00000415204
  CDS Start-End: 188-694
gcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctag

SEQ ID NO: 141571 - DNA, 636 bp, Homo sapiens
  Payload ID: 7840
  Gene Symbol: HYAL3
  Gene Name: hyaluronoglucosaminidase 3
  Uniprot ID: O43820
  ENST ID: ENST00000513170
  CDS Start-End: 19-435
ccagaggccagcatcaacatgctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtc

SEQ ID NO: 141572 - DNA, 1696 bp, Homo sapiens
  Payload ID: 7840
  Gene Symbol: HYAL3
  Gene Name: hyaluronoglucosaminidase 3
  Uniprot ID: O43820
  ENST ID: ENST00000621157
  CDS Start-End: 29-1282
ggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactg

SEQ ID NO: 141573 - DNA, 2407 bp, Homo sapiens
  Payload ID: 7841
  Gene Symbol: HYAL4
  Gene Name: hyaluronoglucosaminidase 4
  Uniprot ID: Q2M3T9
  ENST ID: ENST00000223026
  CDS Start-End: 639-2084
tctttattttatttatgctatctatttcttttccttttttttttttttttttttttttgagatgaagtcttactctgttgcccaggctagagtgtagtggtgtgatctcggctcactgcaaccactgcctcctgggttcaagtgattctcctgacttaacctcctgagtagctgggactacaagagcatgccatcatgcccagctaatttttgtatttttagtagagatggggtttcaccatattggccagaatggttttgcattcctgacctcaagtgatctgcctgcctcagcctcccaaaatgttgggttacaggggtgagccaccgtgccttgctatttatgccatctatttcactgaagattccgcctctcatttcttgagtcattttttttaaatttccttaaattggacttcacatttttctgatgcctccttgtttagcttaataactgaccttctgaattcttttttaggaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctccttattggaatatttaagttgcatttaaactaaaactagtataatttagtcttttcatgaatgtacatacataaaattatacataaaaatattaaattattcatttcaaa

SEQ ID NO: 141574 - DNA, 1616 bp, Homo sapiens
  Payload ID: 7841
  Gene Symbol: HYAL4
  Gene Name: hyaluronoglucosaminidase 4
  Uniprot ID: Q2M3T9
  ENST ID: ENST00000476325
  CDS Start-End: 141-1586
ttgtctgaaccacgcacaggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggc

SEQ ID NO: 141575 - DNA, 314 bp, Homo sapiens
  Payload ID: 7841
  Gene Symbol: HYAL4
  Gene Name: hyaluronoglucosaminidase 4
  ENST ID: ENST00000488323
  CDS Start-End: 178-314
ccagtgagatgaaccaggaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaa

SEQ ID NO: 141576 - DNA, 589 bp, Homo sapiens
  Payload ID: 7841
  Gene Symbol: HYAL4
  Gene Name: hyaluronoglucosaminidase 4
  ENST ID: ENST00000489978
  CDS Start-End: 399-589
tatccgagggcctttgggccattatgctgtgaatgtgacatctgcagccaagctctgcagtcagagtctatgtaacaatcatggaagagtattcgaaaaacacctgagtcctccttctatctgcatatgcctgaaagcagtgtcaggtccctcagctgcaggtctgttggagtttgctggaggtccattccagaccttgtttacctgggtatcaccagcggaggctgcagaaccgcaagaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataa

SEQ ID NO: 141577 - DNA, 1609 bp, Homo sapiens
  Payload ID: 7841
  Gene Symbol: HYAL4
  Gene Name: hyaluronoglucosaminidase 4
  ENST ID: ENST00000483878
  CDS Start-End: 77-1126
ggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggtgtgatatttccaccccagtcccttggtggctcgtcagaagagcttcatcaggaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggc

SEQ ID NO: 141578 - DNA, 2792 bp, Homo sapiens
  Payload ID: 7842
  Gene Symbol:
  Gene Name: HYDIN
  ENST ID: ENST00000635365
  CDS Start-End: 1-455
gtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggatagtgaaagagaagctggtgtgccacgccatcatcggggcacagaa

SEQ ID NO: 141579 - DNA, 592 bp, Homo sapiens
  Payload ID: 7842
  Gene Symbol:
  Gene Name: HYDIN
  ENST ID: ENST00000635095
  CDS Start-End: 1-130
taattcaggacgtgtccagctggaattcagctgggtctcagaagatacctcaaaggcagtcagctttgcaaaaccagatcaccaaggattcccaacctgccacctggagagcaaggtccggtcctggtagcaaaagggcggagcaccttgcccatctgccattttgatctgaaagactcggactacataagtggccatcagcgcaacccagagctccgagggtccagtgggggagctctggatccaaacacccgggtgattgagttcaccactgtgggcataggagggaagaatctccggacctttaccatcctaaacccaaccaatagcacctactccttctgctggatctctgaagaaattgaaagtctccagaaccctgcagcattcacatgccttacagaaaagggcttcatccaccctgaaaagaaagccgagatcgtgttccagttcacacctttccatctgggcatcactgagtcatcatggaccttcctaattcccgagcacaacatcacagtccctttcctgctggtaggcaaaactaccgaacctctcatctctctgaacaagtcacacctcaacttcagct

SEQ ID NO: 141580 - DNA, 2953 bp, Homo sapiens
  Payload ID: 7842
  Gene Symbol:
  Gene Name: HYDIN
  ENST ID: ENST00000634987
  CDS Start-End: 15-2192
agctcgggcggcgcatggagagtgcgggcggcttcaagctgggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtattgctccccagcttgctcttctcctgagtcgcccccgagcctccagtaatgggctgcctcccagaaggcagctggcctgccaacccaagcacactgagtttgtcctgccttcctgggaagggaagttgaatctgacattcaaatgacaaagcagcaaatgtttctaaagcacctttggtggagataagaagaagtgtgtgtgttttgtagagtttaggcagagaatcctaagaatagtgaaaaaacgggtcagaccctctctaacgggtttgactttcaaagtatgtaaccagaaaggttttagcaggaagaggtgaagagctgctcatttttattttcatctttcaacatagtgctccagagttatgcaataggaaggtgatgctgtcagtcctgcagtggaagatccatagagccaagaggtccctgccccgggacactgttgctgtgacttgaatttcaggctaggagtgggcccccaagatgaggctcatctttaacaaggtatactcctcagaaccatctccaactcctctctctttttgagagaggcagctgggttaaaatcctggctcagccatttgttgactgtgtccttttgaccaagctacagtcattgcagtactgctgatgagggtggtggtgtcatcgactaatgatgatgtgatcccaaataaaatcctggggccacactcttcccaaagcaatcagtgtccagatctgggactttaagttgtatgtatgcaaatgctatgtataggaaatagagaaaatgacttaggaaaactgataatcatgctaatatgtcaa

SEQ ID NO: 141581 - DNA, 540 bp, Homo sapiens
  Payload ID: 7842
  Gene Symbol:
  Gene Name: HYDIN
  ENST ID: ENST00000634434
  CDS Start-End: 432-540
aacagctcgggcggcgcatggagagtgcgggcggcttcaagctgggtatggagcccctcagcggcggcggggtctagtctgactctgtcacccaggctggagtgcattggcaagatcccagctcactgcaacctctgcttctcaggctcaagccatcctcccacttcagtctcccaagtagccgggactaaaggtgtgcaccaccatgcacagctaatcttggtattttttgtagagatggggtttcaccatatttcacaggctggtcttaaactcctgagctcaagtgatctgcccacctcggcctcccaatgtgctggggaactattttctgttatctgttctggactcacacattctggatgactggaattctttggacccatatgagcctctgcaaagacattggtgagaaaaaaaaattactaaaaatgacaagtagaagacttgaggagtccatgggggctgttcagatgggattggtcaatatgttcaaaggatttcaaagcaaggttttgccacccctgagtccaaaggtgg

SEQ ID NO: 141582 - DNA, 609 bp, Homo sapiens
  Payload ID: 7842
  Gene Symbol:
  Gene Name: HYDIN
  ENST ID: ENST00000634726
  CDS Start-End: 491-609
ggcggcgcatggagagtgcgggcggcttcaagctgggtatggagcccctcagcggcggcggggtctgtgagttggacgcggggtcttggcggggaatggaggtagaataaacgtgggacccggagtgcaccaagagtctgactctgtcacccaggctggagtgcattggcaagatcccagctcactgcaacctctgcttctcaggctcaagccatcctcccacttcagtctcccaagtagccgggactaaaggtgtgcaccaccatgcacagctaatcttggtattttttgtagagatggggtttcaccatatttcacaggctggtcttaaactcctgagctcaagtgatctgcccacctcggcctcccaatgtgctggggaactattttctgttatctgttctggactcacacattctggatgactggaattctttggacccatatgagcctctgcaaagacattggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaaga

SEQ ID NO: 141583 - DNA, 2595 bp, Homo sapiens
  Payload ID: 7842
  Gene Symbol:
  Gene Name: HYDIN
  ENST ID: ENST00000634415
  CDS Start-End: 1-1587
gtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgccacacaggaactgagagatcctcaagtactgattccctttcagcggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaagtgctccagagttatgcaataggaaggtgatgctgtcagtcctgcagtggaagatccatagagccaagaggtccctgccccgggacactgttgctgtgacttgaatttcaggctaggagtgggcccccaagatgaggctcatctttaacaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttaggtaaggaaatctcatggaccagtttttatagatatcacatatgttacatatgctgagcatcacctctactttagaaaattattttaagtaattaaaactagccacctcagtccctctcctttcccatcctcactcttccacctcctgatgtgtatgtcagcaacaagaagacattttctagccataacttggttgcattctctaatccgtgtccctctacatccgagaagaatatggtttgtaggaaatgcattcttttctcaaact

SEQ ID NO: 141584 - DNA, 3091 bp, Homo sapiens
  Payload ID: 7842
  Gene Symbol:
  Gene Name: HYDIN
  ENST ID: ENST00000635262
  CDS Start-End: 1-2502
cgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggaaacctaacagtatcctgaaacctgattaccagcccttggccataaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctgaacaactgggtggcagaagaaattctagcaattaagtatgtggaacaccctcagatagacagcctggacctgcgcggagaagtgcattaccccaacctcagctttgagacaaaggagctggattttggctgcatcctgaacgatactgagctcattcgctacgttaccatcaccaactgcagtccgttggttgtgaagtttcgctggttcttcttggtgaatgatgaggaaaatcagataaggtttgtgacattgccgaagaagccctacagtgccccagtgtcccagatggagtccatcccagcaacctcagaggctgccagcccaccagcaatcctagttacagtagagtcccccgagatggatttaaatgattttgttaagaaataaaaattagctctactgaaatagaaagaatatactcaagccagagccaggtggaggatcaggaatccctacagacctgtgaacagaatgagatgctttccattgggatagaagaagtgtttgatattttgcccctgtttggagtgttgcagccacacagtagccaccaaatatcgttcaccttctatggacacgctaacatcattgcacaagctaaagctctgtgtgaagtggaagaaggacccacctacgaaataacactgaagggagaggcgtccctggtcaactattcctttgacaccaaggatattcactacggattacagctgtttgaccatgtcacagagagggaaatcacgctgacgaacatggggaaagttggctttgagttcaaggttctgactgaccaccagtcttctccagacaaccttctccctggagtgccactaatcctgcctgtgtctgtaagtaaatggtgggaggggcccgaattcaaacctacgagccccactccgaagcaggtgagtattcacgaccaggattacaagtgtgattttttctttttgttaaaactaaagaactctcggaagca

SEQ ID NO: 141585 - DNA, 3152 bp, Homo sapiens
  Payload ID: 7842
  Gene Symbol:
  Gene Name: HYDIN
  ENST ID: ENST00000634268
  CDS Start-End: 36-2888
accgtggcaacggacggcaacagctcgggcggcgcatggagagtgcgggcggcttcaagctgggtatggagcccctcagcggcggcggggtctgtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttaggtaaggaaatctcatggaccagtttttatagatatcacatatgttacatatgctgagcatcacctctactttagaaaattattttaagtaattaaaactagccacctcagtccctctcctttcccatcctcactcttccacctcctgatgtgtatgtcagcaacaagaagacattttctagccataacttggttgcattctctaatccgtgtccctctacatccgagaagaatatggtttgtaggaaatgcattcttttctcaaactg

SEQ ID NO: 141586 - DNA, 3058 bp, Homo sapiens
  Payload ID: 7842
  Gene Symbol:
  Gene Name: HYDIN
  ENST ID: ENST00000634392
  CDS Start-End: 28-2850
aacggacggcaacagctcgggcggcgcatggagagtgcgggcggcttcaagctgggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttaggtaaggaaatctcatggaccagtttttatagatatcacatatgttacatatgctgagcatcacctctactttagaaaattattttaagtaattaaaactagccacctcagtccctctcctttcccatcctcactcttccacctcctgatgtgtatgtcagcaacaagaagacattttctagccataacttggttgcattctctaatccgtgt

SEQ ID NO: 141587 - DNA, 3685 bp, Homo sapiens
  Payload ID: 7842
  Gene Symbol:
  Gene Name: HYDIN
  ENST ID: ENST00000634745
  CDS Start-End: 152-3205
gcatggagagtgcgggcggcttcaagctgggtatggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccagggtaaggggatagcacatttggaagctattgttttttcctaaataaatctctactgtatctatttcttaggaaagtcccttgacatttatctgaggaaggatatggtttctcaaggattgtgtacaatcctgagttaccatagtagcatccgttgctttcggggtgcagctctgctcagtcttcaatttgtttctgtagctactgtgaacccaatcttaaaggaggttctcatgcccagggtccacagtgaccagccagcaagtctctggtagaaaaacacccagtttttagccaaagcaaattctcctattaacacttagcaggatgaatttaatattcattcaaaaagggtgtttatatcgacactctgggctgcctctcctattcaggtattgggacatccctgttcctttctttccagcctgactgcaactcacatttcaaaacatcttctttttatgcattaataaaagagccacatttatcttcagc

SEQ ID NO: 141588 - DNA, 525 bp, Homo sapiens
  Payload ID: 7842
  Gene Symbol:
  Gene Name: HYDIN
  ENST ID: ENST00000634827
  CDS Start-End: 1-341
atatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagaaacctaacagtatcctgaaacctgattaccagcccttggccataaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttccta

SEQ ID NO: 141589 - DNA, 554 bp, Homo sapiens
  Payload ID: 7842
  Gene Symbol:
  Gene Name: HYDIN
  ENST ID: ENST00000634629
  CDS Start-End: 1-248
aaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcatgggacacccttgtcaggtaggcaacagttctgaggggaggttaagaccagcagtgccatgtcttctctgtaaactctgcggcttccagagtggcaacatcagctgtgtggtcatggcaaatactaatgactttatttgaggaactgcatagggtagtgaatatacattaatagctgtgtgcctttgggaaaattaactaaattgtctgtgctcagtttccctgtccgtaaagtggtattaacgctgtctattttatagggtagtcatgagaatttaatgagaacatttatataaaatgcttatctcaatacttggcacatagtaaatactcaaacgaaa

SEQ ID NO: 141590 - DNA, 4479 bp, Homo sapiens
  Payload ID: 7842
  Gene Symbol:
  Gene Name: HYDIN
  ENST ID: ENST00000634869
  CDS Start-End: 1-148
agtactagaagaaaactaccaagaactgcagcttcaaatcagtgccaatgtggatttcgcttcataccattgccaagcaagagatgtgcgctttaaggaaaccttggtttaccagacccgagtgtttgacataatgtcatgtgcatgaagcaaaggggtatttaaagcagatcaagagagtcaaggaaggcttcctggacaaggtagttccccagctgaactttagaggacagataggaggtaaccaagtaaagaagtgagaacaaagtgagagtgaaagaagtgagaatgggggtagccaagtgaagaagcgagaatgaagggctctctctaggcagagagagcaacatgtgcaacacatacaaggacaaaaatgttcgatgtgattaattcaggacgtgtccagctggaattcagctgggtctcagaagatacctcaaaggcagtcagctttgcaaaaccagatcaccaaggttcagctcaaaaagatcagcttagtcagggcacgatgcatacaggcagcaccctggacagcaccatggaccactgggccgagggttccccacagcccttctctgtggagccctcttcgggaatcgtgccggtggggaagattcagaagttcaaagtaaaattctccccgttggacattggagacttcgagagcaaccttttctgccagattcccaacctgccacctggagagcaaggtccggtcctggtagcaaaagggcggagcaccttgcccatctgccattttgatctgaaagactcggactacataagtggccatcagcgcaacccagagctccgagggtccagtgggggagctctggatccaaacacccgggtgattgagttcaccactgtgggcataggagggaagaatctccggacctttaccatcctaaacccaaccaatagcacctactccttctgctggatctctgaagaaattgaaagtctccagaaccctgcagcattcacatgccttacagaaaagggcttcatccaccctgaaaagaaagccgagatcgtgttccagttcacacctttccatctgggcatcactgagtcatcatggaccttcctaattcccgagcacaacatcacagtccctttcctgctggtaggcaaaactaccgaacctctcatctctctgaacaagtcacacctcaacttcagctctctcctcattggcagagaagccagggagactgtgcagatcattaacaaggaggagcaggggttcgatttttccttccaggacaactcccgctattctgaaggtttcagcaacagcctgcttgtatgtcccatggaaggctggatcccaccactgtccaggttcccaattgatattttcttcacaccaaagcaggaaggagatgtgaactttaatttgatctgcaatgtggaaaagaaagtccaccctgtgacattaaatgtcaaggccgagggctacactatgaatgtggagatcaagtgcaaggacaggacaggctccatcactctgttgactcccaaccagactaacatcatcaacttctatgaggtggagttaaatgaatgtgtccagtgtgaattcaactttatcaacactggaaagttcaccttcagcttccaggcacagctgtgtggctccaaaaccttgctgcagtacttggaattttcacccatcgacagcactgtggatgtaggacagagtgtacatgccaccctgtcttttcaaccattaaagaagtgtgtcttgacagacctggaactcataatcaagatcagccatggtccaacatttatgtgcaacatctcaggctgtgctgtgagcccggctatccatttctccttcaccagctacaactttgggacctgctttatctatcaagctgggatgcccccatacaaacaaaccctggtaattaccaacaaggaagaaacacctatgagcatagattgtctgtacaccaacaccactcacctcgaggtgaactcccgtgttgatgtggtaaagccaggaaacacattggagattccaataactttttatcctcgagaaagtatcaactatcaagaactcattccctttgaaatcaatgggctctcacaacaaacagtcgaaatcaaagggaagggtaccaaaatgaagattttagtcctagatccagccaacaggattgtgaagttgggagctgtcctaccagggcaggttgtgaaaagaacagtttccatcatgaacaacagcctggcccagctcacatttaatcagtccattctgttcacaattccagaactccaggaacccaaggtccttaccctggcgcccttccacaacatcacactgaagcccaaagaagtctgtaaactggaagtcatctttgccccgaagaagcgtgtccctcccttctctgaggaagtgttcatggaatgcatggggctcctgcgccccctcttcctccttagcggctgctgccaggccctggagatctcactggaccaggaacatattccctttggacccgtggtgtatcagacgcaagccacacgtcgcatcctcatgatgaacacaggcgatgtgggtgcaaggtttaaatgggacatcaaaaaatttgagcctcatttctccattagcccagaagaaggctatattacctcaggcatggaggtttcttttgaagtgacctaccatcccaccgaggtgggaaaggagagcctttgtaaaaacattctctgctacatccagggaggcagtcctctgagtctaaccctgtctggagtctgcgtgggaccacctgcggtaaaagaggtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagagattccgggtcatcgtggaaatactgaaaccagagaagccggacctaagcatcactatgaagggccttgattacattgatgtactgtctggctctaagaaagactacaagctgaacttcttttcccacaaggagggaacgtacgctgcaaaggtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacggaatgccggatgcccgacatcgccctgccctcccagtttgtggtgcctgccaactccgagagatggggtctcactgcgtcttccaggctggagtgcagtggtatgatcatagctccctgcagccttaaactcctacaatcaaggcctcctcctgcctcagcctcctgagtagctaggactacagggcacgttctcatttgaatttcagcccctgaaagctggagaaaccttcggaagactaactttgcacaacactgacttgggttactaccaatatgagctctatctgaaagccacgccagcacttccggaaaagcctgttcacttccagactgtccttggcagcagccaaatcatccttgtgaagttcatcaattacacacggcagaggacagaatactactgcaggaccgactgtacagacttccacgcagaaaaactcattaatgcagccccaggaggccagggaggcactgaagccagtgtggaagtcttattcgagcccagccacctgggtgagaccaagggcatcctgatcctatcatcgctcgcaggtggagagtatatcatccccctctttggaatggctctgcctcccaagccccaaggtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttagtggtaaccagggttacctgtatcaaccaaaagctatgcattgtcttagcctgaaaaagaatagagaaaacaataagaattctaaa

SEQ ID NO: 141591 - DNA, 2480 bp, Homo sapiens
  Payload ID: 7842
  Gene Symbol:
  Gene Name: HYDIN
  ENST ID: ENST00000635355
  CDS Start-End: 1-614
tccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatataggtggatggctccatttgttccaggccaagtgtggacatgggagtatttcctctagctctcaagaccatggctcttagtttttaatctcctcagcattcagttggcacctcttgtgggtgctgaagggagcagattacaggccttgagtacctgaagatgagggactattactcgttcaaccctgctgcactggagacacacatcttccccattgactgttaaaggtgttggtagctactagaccatttgtaaaatgggttaagcccatggttttactgaagagagggctggcctgctgttatgctgtctgatgaaaggtctcctcatctataaaagagaaccacctctgagtgcaagaaaccatgactatcaacaggacgagatggcaaaacactaggactgagatctatggaagcccttgttggagccaggccacatgaagttgtggctatacacctcctccttagactctcagtcctggctccaattctccatcagaggaagaatccagtaccctctctcctccctttgccttctactggctgttttggagtttcaacagcatgggagaagaccagcgttttcgaatttgttttgttctctttgttttctggtacagggattgcatttctcatactcctcagtccatggagcactatcatcttcatcctcagtccacacaaagcattttatttattctcttacatccccacaccccactcctgttaattcccccaaagataccattctaatatgttactgtgtctatctttttacatgaatctgttctttcaaaatgtatattgtcttgggggagagacagagagaagtcatattttgtattccattttctcctttttctcacgaggttgtgtgcttaagatccattcatgttgctatgtgtatatctaatccattgcctccaccttctgcagaccagaccacattgtgtcaccccacattccacctgtgcactcttccaggggtggcatccacaggctcatgccaatgcaggcatgttaggcaaaggcaaccaggtcaaaatcttagtgcctcagcctgagaattaattaacatttaatttcttaaatgacttgttttctggtttaaaaagaaatacattgtgcactaataaaatttagaaaatattaagcacaaagatgagggcaaaaatccattctaatccttccaaccagggaaaccacagtcaatattttggtatgtctaagtctgtattttttccctaataagtatgtatttttcttttgcttttttattacaaaagtgggattattgtatatgttacattttaccactttgtttttcaccttaaaacatttcagacatttgaaaatgatgttaagtattccatttaataccactttactggctgcttattattccctaatattccctggattcctgggaggcagtgtgcatattggttagcaccaggggattcaaacctccaaagaccctgaagtccaggctatctttcagctatgtgatctggggcgagttacttaacctttctaagcctcagtttcatcatctatatagtgggaatgatgcttataatgctaatgacccttctggtagttatgagtgttaaattatatgatgcatgtgcaaagtttgacaggtacccaataaatgtaatgttcatgattcccatttctgttcaaccagtgcttcattatcttacatcaaatttacccacttgatctggtatcattccagcactttaatggacatctttgtagctgtgtctttgtttatatccatgattgtttttaaggatttattcctgcaagtggaattttttggtttctaagggtatataatctgtaagttttccagatcagtatcagataacaaaaatatcaaataaaaaagaaatggattcctttctttctgcaaa

SEQ ID NO: 141592 - DNA, 634 bp, Homo sapiens
  Payload ID: 7842
  Gene Symbol:
  Gene Name: HYDIN
  ENST ID: ENST00000635523
  CDS Start-End: 1-383
acaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaagtgctccagagttatgcaataggaaggtgatgctgtcagtcctgcagtggaagatccatagagccaagaggtccctgccccgggacactgttgctgtgacttgaatttcaggctaggagtgggcccccaagatgaggctcatctttaacaaggtatactcctcagaaccatctccaactcctctctctttttgagagaggcagctgggttaaaatcctggctcagccatttgttgactgtgtccttttgaccaagctacagtcattgcagtactgctgatgagggtggtggtgtcatcgactaatgatgatgtgatcccaaataaaatcctggggccacactcttcccaaagcaa

SEQ ID NO: 141593 - DNA, 15719 bp, Homo sapiens
  Payload ID: 7842
  Gene Symbol:
  Gene Name: HYDIN
  ENST ID: ENST00000635381
  CDS Start-End: 152-15517
gcatggagagtgcgggcggcttcaagctgggtatggagcccctcagcggcggcggggtctgtgagttggacgcggggtcttggcggggaatggaggtagaataaacgtgggacccggagtgcaccaaggtgagaaaaaaaaattactaaaaatgacaagtagaagacttgaggagtccatgggggctgttcagatgggattggtcaatatgttcaaaggatttcaaagcaaggttttgccacccctgagtccaaaggtggttacagaagaagaagtaaaccgaatgcttacaccctcagagttcctgaaggaaatgtccctgaccaccgagcagagactggcaaaaacacgtttgatgtgccgaccacagatcatcgaactcttagatatgggggaaacaacacatcagaagttttcaggaattgacctggatcaggcattattccagccctttccatcagaaattatatttcagaactacactccctgtgaagtctatgaagttccactgattttgaggaacaatgacaaaattccaaggttggtgaaagttgtggaagaaagttcgccttactttaaagtaatcagccccaaagatattggccacaaagtggctcctggagtgccttccatattccgaatcctctttactccagaggagaacaaggattacgcccatacgttgacctgtgttactgaaagagaaaagtttattgtacccatcaaagctagaggggcacgagccattctcgattttcctgacaagctgaatttttccacttgtcctgtcaaatacagcacccagaagattctgctggtacgaaacattggcaacaaaaatgctgtatttcacatcaaaacttgtaggcctttctctatagaaccagctattggaactcttaatgtgggagagtccatgcaactggaagtggagtttgagccacagagtgtgggcgatcacagtggaagacttatcgtgtgttatgacacaggtgaaaaggtgtttgtatctctctatggagctgccatagacatgaatataaggctggataagaattccttgaccatcgagaaaacctacatatctctggccaatcagcgaactataaccattcacaatcgcagtaatatcattgcccatttcctgtggaaggtatttgctacccagcaagaagaggacagagaaaaatatagggcctgtgatgatctgatcaaagaggagaaggatgagactgatgagttttttgaagagtgcattactgatcctttactccgagaacatctttctgttctgtcccgaacctttgcgaatcagaggaggctggtgcagggagacagcaagctgttcttcaataacgttttcactgtggagcccctggaaggtgatgtctggcccaactcatcagctgaaatcaccgtgtactttaacccactagaagccaagctctatcaacagaccatttactgcgacattttaggccgagaaatccgtctgcccctccgaatcaaaggggaaggcatgggacctaagattcacttcaactttgaattgctggatattgggaaagttttcactggatctgcacattgttatgaggcgatactgtacaacaaaggcagcatcgatgctctcttcaacatgacccctccaacttcagctttgggggcctgctttgttttcagtcccaaggaaggcatcattgaaccaagtggagtccaagctatccagatctccttcagctctaccatcctgggaaactttgaagaagagttcctggtcaatgtcaatgggtcacctgagcctgtgaaactgaccattagaggctgtgtcattggacctaccttccattttaatgttccagctctgcactttggtgatgtttcctttgggtttcctcataccttgatatgttccctcaataatacctctttgatccccatgacttacaaactgcgtatccctggggatggccttggccataaaagcatttcatattgtgagcagcatgtggactacaaaagaccatcttggaccaaggaagaaatatcctcaatgaaaccaaaagaattcaccatctctcctgactgtggcaccattcgcccccagggatttgctgctatcagggtgacattatgctccaacactgtgcagaaatacgagctggcactcgtggtggacgtggagggcatcggagaagaggtgctggcgctcttaattacagcaaggtgtgttgtacctgccctccacctggtcaatacagaggtggactttgggcactgcttcctgaagtacccgtatgagaaaacactccagcttgccaatcaagatgacctcccaggattctatgaggtccagcctcaggtgtgtgaggaggtgcctactgtgctgttttccagccccacccccagcggggtcatctccccaagcagcaccatccacataccactggtcctggagacccaggtcactggagaacacagatccacggtttacatctcaatctttgggagccaggacccccctttggtatgtcacttaaagagcgctggagaaggcccagttatctacgtccatcccaatcaagtggacttcgggaatatctacgtcctaaaagactcttccaggattctcaacctatgcaaccagtccttcattcccgcatttttccaggcacacatggcacacaaaaaatccctttggacgattgaacccaatgaaggcatggttcctccagaaactgatgttcaactggcactgaccgccaacctgaatgacacactgacattcaaggactgtgttattttggacattgaaaatagcagtacctatcggattcctgttcaggcttccggaactggttccactattgtttcagataagccctttgctccagaactcaatttgggggcacattttagcctggatacccactattaccactttaagttgatcaacaagggacgtcggatccaacagttgttctggatgaatgatagcttccgaccccaggccaagctgagtaagaagggccgggttaagaagggacatgctcatgtccaaccccagcccagtggctctcaggagcccagggatccacagagccccgtgtttcatctccaccccgccagcatggagctgtacccaggccaggcaattgatgtgatactcgaaggctattctgctactcccaggatagtgaaagagaagctggtgtgccacgccatcatcggggcacagaaggggaagagcttggtgatggctgtgaacatcacctgtgagttcgtcgcacctctcatccagctctccaccaagcagctcatctaccgactggagaagaaacctaacagtatcctgaaacctgattaccagcccttggccataaagaacatttccaccctgcccgtgaacttgttgctgtcaacatctggacccttctttatatgtgagactgataaatccctgctgccggcaactcctgagcctattaaactggaaattgatgaagaaaaaaacctgctgatcaagtttgacccttcctacagaaacgatctgaacaactgggtggcagaagaaattctagcaattaagtatgtggaacaccctcagatagacagcctggacctgcgcggagaagtgcattaccccaacctcagctttgagacaaaggagctggattttggctgcatcctgaacgatactgagctcattcgctacgttaccatcaccaactgcagtccgttggttgtgaagtttcgctggttcttcttggtgaatgatgaggaaaatcagataaggtttgtgacattgccgaagaagccctacagtgccccagtgtcccagatggagtccatcccagcaacctcagaggctgccagcccaccagcaatcctagttacagtagagtcccccgagatggatttaaatgattttgttaagactgtccttgtggatgaagatgccaggcctgaagaaaaagaactaagaaaaacgaaagcttccagtgtgatctcagatgaaataaaaattagctctactgaaatagaaagaatatactcaagccagagccaggtggaggatcaggaatccctacagacctgtgaacagaatgagatgctttccattgggatagaagaagtgtttgatattttgcccctgtttggagtgttgcagccacacagtagccaccaaatatcgttcaccttctatggacacgctaacatcattgcacaagctaaagctctgtgtgaagtggaagaaggacccacctacgaaataacactgaagggagaggcgtccctggtcaactattcctttgacaccaaggatattcactacggattacagctgtttgaccatgtcacagagagggaaatcacgctgacgaacatggggaaagttggctttgagttcaaggttctgactgaccaccagtcttctccagacaaccttctccctggagtgccactaatcctgcctgtgtctggctttatcagttcacatcaagagcaggtattaaaagtttactacctacctggagtacctgaggtctttaaaaggagtttccagatacagatcgcccacctggacccagaaaatatcactctgagcggagagggaatctttccccaaatctgcctcgatctccccaggaacctcacagcaaatgaaaagtatgaaatgttcttgaatcaagccaggaaaaacacagacaaagagtataacaaatgtgaaatgctcgatcactttgacataataactgaggaagtgccagaagacgagcctgctgaggtaagtgctcatctccagatggaggtagaaagacttatagtccaaagctatgtcctagaacatcagaaaacaaccacccctgatcctatggatgacccctgcttcagccatcggagtcgccgcaaactggccaaaatccagctaccagagtacatcctggactttggctacatcatccttggcgaagtccgaacccacatcatcaagatcatcaacaccagtcactttccagtgtcattccatgcagacaagcgtgtccttcatgagacaggattcagtactgagctagatcgtgtaaagaatctacctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcatgggacacccttgtcaggaaagtcagccaatgccgttagcgtggccaagtactacaacgcagcctgcctgagcatcgactccattgtgctggaagctgtggccaacagcaacaacatcccagggatccgggcccgtgagctctgcatcagggctgccatagagcagtccgtgaaggaaggagaggaggctgcccaggaggcagctgtgggtcaaaacgtcatagggcaaggacgactgagcactgacaccttgggcaagttagcctccgagatgactctggtggccccagaaattaaacctggaaagagtgttcgtgggagcgtggtgatcaccaaaagcaaggcagacagccatggctccgggtcacagaagcagcatcactcacaccagtctgaaacaccacagatttcctccagccctctccccccggggcccatccaccgctggctcagtgttagtcccagtgtcggaggcgagaccgggctgatgagctgtgtgctcccggatgaacttctcgtgcagatcctggcagagcggatacagctgagtgactgctaccgaggagtggtgtttgatggcctcgacactctctttgctcagaatgctgcagccgccctcctctgcctgctgaaggccattggcagccgggagcatatatacattctcaacatggcccaggattacgcagccatgaaggcccaggagaaagccaaaaaggagcaagaagaacgcaagcacaagggagctcttgagaaagagaaggagcgtctccaaaacatggatgaggaagaatatgatgccctgactgaggaggagaaactcacattcgatcgggggattcagcaggcgctccgcgagcggaagaagagggagcaggagaggctggcaaaggaaatgcaagaaaagaagctacagcaggagctggagcgacaaaaggaagaggatgagctgaaacggagggtcaaaaaaggaaagcagggacccattaaggaggagccccccatgaagaaatctcaagcagcaaacaagcaggttcctccgctcaccaaagtggatgtcaagatggagacaatcgaaaggaaaatatctgttagggaacaaacaatgtctgagaaggaagagctaaataagaagaaaaggaacatgggcgatgtcagcatgcatgggcttcctcttgtccaggaccaagaggacagtgaaggggacaactcaaaggaccccgacaagcaactggccccgaagtttaagacctatgaattgacactgaaggatgtccagaacatcctcatgtactgggaccggaagcaaggagtccagctgcctcctgcagggatggaggaagcgccccatgagcccgacgaccagcgccaggtccccttgggtgggcgcaggggccgcaaggaccgggagagagagcgcctggagaaggagcgcacggagaaggagcgcctggagagggagaaggcggagcgggagcgcctggagaagctgcgagccctggaggagcggagcgactgggagggggaaggggaggaggaccacgaagggaagaaggagaaggacctgggcgtacccttcctagacatccagacaccagactttgaaggcttgagctggaagcaggccctagagagcgacaagcttcccaaaggagagcagatcctagacatcttgggtctgggtgcctccggaccacccatcccgcctcccgccttattctcaatcgtctcctacccggtgaagcggccacctttgaccatgacagacgacctggagcattttgtatttgtgatcccaccatccgaagatatatctctggatgaaaaaaaagaaatggaaatagaatcagactttttggccaccacaaacactacaaaggctcaagaggagcagaccagctcatctaaggggggcaaacagaaaatgaaagaaaagatagaccaagtcttcgagattcagaaagacaagcgtcacatggccttaaacaggaaggtcctttctggggaacctgctggaaccatttcccagctgtcagatacagacctggacaacttcaacgggcagcactcccaggagaaattcaccagactgaatcacttccggtggatcgtgccagccaatggcgaggtaacgttgcaggtgcacttctcttctgatgagttcgggaactttgaccaaacctttaactttgagatcctaggaacttgctgccagtaccagctctactgccgaggcatctgcacttacccatacatttgccaagacccaaaagtggtatttcctcagcggaagatggacatgaagacaaatgaggtcatctttaagaagtatgttatgagcacggagacgtactactttgggccactactttgtggaaaatcaagagataagtacaagtcatccttattcccaggcaacatggagacgctaacaatcctgaacacttccttaatggtggtggaggcatccttctattttcagaatgatgtcaaagcaaacacgtacttcctggaacccaacaccatggtcctgaaacccaatgagaagcagatattaaacgtatgggcctaccctacttcagttggtgtctttgaagacagcattgtctgctgcatcaatgacaacccagagccagccatcttccaattaagctgccaggggatccgcccggaactagagctggaacccaggcaattacattttgaccggctcttgctgcacagacaggaatccagggtagttcttctccgcaatgtcacgctcctgcctgtggcctggcggatcaccagcctggagcacttgggtgatgatttcactgtatccctgatgcaggggaccatcccccctgaggctgagtacggcctgcacctgtactttcagcccaccaagcctgtcaacatcaagaaggctattcggttggaggttttagatgcagaaaatcttcttggtgttgttcagattgaaaatatcatggtctttgcagaggcatacgacatcgccttggacatcaccttccccaaaggagctgaagggggactggattttgggattgtcagggtcacagaggaggcgaagcagcccctgcaattgaagaaccgtgggaaatatgagatcgcgttcagcttttccgtggactctgtagggatttcaacacctaatataaattccatgatctcagtccaacccaaaaagggttcactgaccccaacagaaaaacccacaaatgtccaagttttcttccatgcaaaaaaggaagtgaagattgagcaccagcctgttctgcgctgtcagattattgagcccaatatttcagaaggaggtgagatcattgccagcatcccaattaagttttccgcgaatgcagtatattccaaatacaacatcaccccctcctctgtcatcaactttggagctttgatctgtggcactcgtaaaagcaccaccttcaccatagaaaatcaaggtgttactgacttcaagttcgccctttataagctgacaggggagagccccattcatcaaaagaaagcagccagccacgtcagacatgcaagatcccgagaaagtgagagcttctacaaaactggctcttccagagcagccaagttctctgacacgattcagaaagaagtaaccaccacaggccaggcccgcttcgcccatggcatgttcaccgtgtaccctgggtttggctccattccttccggaggacagcaggtcatcaacgttgactgtgtggctgacgccatgggaaagtgtgaggagtttatagccatcgatatctccggccgagaccctgcagtccaccctgccggcattctttacactttgctagctgaagcctgtctaccagccttcgtgaccgaaaacaatgccttgatatttgaagagcaccagatatgtaccagtgccaacctgcaccacatcctgcagaccatagagagcggggggctgttcgtcgaggatgagaacaagttcatcttctgcaatgtcctggtgggccgccaagccaaggctcgtttcaagatcagcaacgtgggaaagatcacctgtgatgtcaacattgtagtcaggcctatctccaataagccctttgcccgcatcgtcgacatttttgaagtggaacccagcaagatgtgcattgccagtcattcccatgcctttgccacggtgtccttcaccccgcagatcatgcagaactaccagtgcatctttgaggctaccttggatggcttgcccagcaccctggccaagagccgaggcctcgtgtttgacatcgctggtgaggggaacctccctcgagtgacggttgtgcggccagttcttcataaccaatatggaaaccccttgctcctctttaagaggcttctccttggtcattcagagaagctgcctctcatcctcaagaacaatggtgtcctccctgcccagctgcatgttgacctgcaggatgagctaggagtcttctccctgaaagggaggcccaccaccgcgtatatctacatcacagaggaaaataaaccacatgtaaaagcaaagaaagctcacacagcctccttggttgtttctcctggagatacagctgaatttgatgtcgttttccactcccagaaggttgggaggatgagaggtatcatccacttgtcagtgatcaacaaccaatatgaggagacctccatccacatggtgggagagggctatgaggatgacatcaccttggacaacatccatggactggtggcccccaccagccaggaagacataagtatctctgagttcacagagatcatcgaggacaatgatatggaagacttggtggcagctgctctggtggaccacatccaatttggggactgccacattggacacagctataatgcgagcttcacagtcacaaatcacagccaagtgaacttgatacggtttgaatggcctgtttcagctacaattgctttctccccacagatgggccacctccaccctgggtgtgccaaggacatagtggtgaccatgaagtcagatgtacccatcaacctaaagaatatgcggatcaggtgcaagctctccaggattatgtttcagctccctgcagaccaggtccccgactgggatgaccgcatgcacacagtcaagtgggtggacgtacccagaaacatgcctgggactttcactacaaaacgaaaagtgatagagacggatccggaacctgctcactcagtactagaagaaaactaccaagaactgcagcttcaaatcagtgccaatgtggatttcgcttcataccattgccaagcaagagatgtgcgctttaaggaaaccttggtttaccagacccgagtgtttgagttcgatgtgattaattcaggacgtgtccagctggaattcagctgggtctcagaagatacctcaaaggcagtcagctttgcaaaaccagatcaccaaggttcagctcaaaaagatcagcttagtcagggcacgatgcatacaggcagcaccctggacagcaccatggaccactgggccgagggttccccacagcccttctctgtggagccctcttcgggaatcgtgccggtggggaagattcagaagttcaaagtaaaattctccccgttggacattggagacttcgagagcaaccttttctgccagattcccaacctgccacctggagagcaaggtccggtcctggtagcaaaagggcggagcaccttgcccatctgccattttgatctgaaagactcggactacataagtggccatcagcgcaacccagagctccgagggtccagtgggggagctctggatccaaacacccgggtgattgagttcaccactgtgggcataggagggaagaatctccggacctttaccatcctaaacccaaccaatagcacctactccttctgctggatctctgaagaaattgaaagtctccagaaccctgcagcattcacatgccttacagaaaagggcttcatccaccctgaaaagaaagccgagatcgtgttccagttcacacctttccatctgggcatcactgagtcatcatggaccttcctaattcccgagcacaacatcacagtccctttcctgctggtaggcaaaactaccgaacctctcatctctctgaacaagtcacacctcaacttcagctctctcctcattggcagagaagccagggagactgtgcagatcattaacaaggaggagcaggggttcgatttttccttccaggacaactcccgctattctgaaggtttcagcaacagcctgcttgtatgtcccatggaaggctggatcccaccactgtccaggttcccaattgatattttcttcacaccaaagcaggaaggagatgtgaactttaatttgatctgcaatgtggaaaagaaagtccaccctgtgacattaaatgtcaaggccgagggctacactatgaatgtggagatcaagtgcaaggacaggacaggctccatcactctgttgactcccaaccagactaacatcatcaacttctatgaggtggagttaaatgaatgtgtccagtgtgaattcaactttatcaacactggaaagttcaccttcagcttccaggcacagctgtgtggctccaaaaccttgctgcagtacttggaattttcacccatcgacagcactgtggatgtaggacagagtgtacatgccaccctgtcttttcaaccattaaagaagtgtgtcttgacagacctggaactcataatcaagatcagccatggtccaacatttatgtgcaacatctcaggctgtgctgtgagcccggctatccatttctccttcaccagctacaactttgggacctgctttatctatcaagctgggatgcccccatacaaacaaaccctggtaattaccaacaaggaagaaacacctatgagcatagattgtctgtacaccaacaccactcacctcgaggtgaactcccgtgttgatgtggtaaagccaggaaacacattggagattccaataactttttatcctcgagaaagtatcaactatcaagaactcattccctttgaaatcaatgggctctcacaacaaacagtcgaaatcaaagggaagggtaccaaaatgaagattttagtcctagatccagccaacaggattgtgaagttgggagctgtcctaccagggcaggttgtgaaaagaacagtttccatcatgaacaacagcctggcccagctcacatttaatcagtccattctgttcacaattccagaactccaggaacccaaggtccttaccctggcgcccttccacaacatcacactgaagcccaaagaagtctgtaaactggaagtcatctttgccccgaagaagcgtgtccctcccttctctgaggaagtgttcatggaatgcatggggctcctgcgccccctcttcctccttagcggctgctgccaggccctggagatctcactggaccaggaacatattccctttggacccgtggtgtatcagacgcaagccacacgtcgcatcctcatgatgaacacaggcgatgtgggtgcaaggtttaaatgggacatcaaaaaatttgagcctcatttctccattagcccagaagaaggctatattacctcaggcatggaggtttcttttgaagtgacctaccatcccaccgaggtgggaaaggagagcctttgtaaaaacattctctgctacatccagggaggcagtcctctgagtctaaccctgtctggagtctgcgtgggaccacctgcggtaaaagaggtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagagattccgggtcatcgtggaaatactgaaaccagagaagccggacctaagcatcactatgaagggccttgattacattgatgtactgtctggctctaagaaagactacaagctgaacttcttttcccacaaggagggaacgtacgctgcaaaggtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacggaatgccggatgcccgacatcgccctgccctcccagtttgtggtgcctgccaactccgagggcacgttctcatttgaatttcagcccctgaaagctggagaaaccttcggaagactaactttgcacaacactgacttgggttactaccaatatgagctctatctgaaagccacgccagcacttccggaaaagcctgttcacttccagactgtccttggcagcagccaaatcatccttgtgaagttcatcaattacacacggcagaggacagaatactactgcaggaccgactgtacagacttccacgcagaaaaactcattaatgcagccccaggaggccagggaggcactgaagccagtgtggaagtcttattcgagcccagccacctgggtgagaccaagggcatcctgatcctatcatcgctcgcaggtggagagtatatcatccccctctttggaatggctctgcctcccaagccccaaggtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttagtggtaaccagggttacctgtatcaaccaaaagctatgcattgtcttagcctgaaaaagaatagagaaaacaataagaattctaaaggaactgtttttattcttctcatacaattatagggcagttatttccctattatgtgttttccaaatatagatatgaaatatctattccatattaaacattataactacacacaacag

SEQ ID NO: 141594 - DNA, 2953 bp, Homo sapiens; identical to SEQ ID NO: 141580
  Payload ID: 7843
  Gene Symbol: HYDIN
  Gene Name: HYDIN, axonemal central pair apparatus protein
  ENST ID: ENST00000288168
  CDS Start-End: 15-2192

SEQ ID NO: 141595 - DNA, 3685 bp, Homo sapiens; identical to SEQ ID NO: 141587
  Payload ID: 7843
  Gene Symbol: HYDIN
  Gene Name: HYDIN, axonemal central pair apparatus protein
  Uniprot ID: Q4G0P3
  ENST ID: ENST00000321489
  CDS Start-End: 152-3205

SEQ ID NO: 141596 - DNA, 15719 bp, Homo sapiens; identical to SEQ ID NO: 141593
  Payload ID: 7843
  Gene Symbol: HYDIN
  Gene Name: HYDIN, axonemal central pair apparatus protein
  Uniprot ID: Q4G0P3
  ENST ID: ENST00000393567
  CDS Start-End: 152-15517

SEQ ID NO: 141597 - DNA, 3058 bp, Homo sapiens; identical to SEQ ID NO: 141586
  Payload ID: 7843
  Gene Symbol: HYDIN
  Gene Name: HYDIN, axonemal central pair apparatus protein
  Uniprot ID: Q4G0P3
  ENST ID: ENST00000541601
  CDS Start-End: 28-2850

SEQ ID NO: 141598 - DNA, 2480 bp, Homo sapiens; identical to SEQ ID NO: 141591
  Payload ID: 7843
  Gene Symbol: HYDIN
  Gene Name: HYDIN, axonemal central pair apparatus protein
  ENST ID: ENST00000538382
  CDS Start-End: 1-614

SEQ ID NO: 141599 - DNA, 540 bp, Homo sapiens; identical to SEQ ID NO: 141581
  Payload ID: 7843
  Gene Symbol: HYDIN
  Gene Name: HYDIN, axonemal central pair apparatus protein
  ENST ID: ENST00000545267
  CDS Start-End: 432-540

SEQ ID NO: 141600 - DNA, 609 bp, Homo sapiens; identical to SEQ ID NO: 141582
  Payload ID: 7843
  Gene Symbol: HYDIN
  Gene Name: HYDIN, axonemal central pair apparatus protein
  ENST ID: ENST00000539973
  CDS Start-End: 491-609

SEQ ID NO: 141601 - DNA, 3152 bp, Homo sapiens; identical to SEQ ID NO: 141585
  Payload ID: 7843
  Gene Symbol: HYDIN
  Gene Name: HYDIN, axonemal central pair apparatus protein
  Uniprot ID: Q4G0P3
  ENST ID: ENST00000538248
  CDS Start-End: 36-2888

SEQ ID NO: 141602 - DNA, 634 bp, Homo sapiens; identical to SEQ ID NO: 141592
  Payload ID: 7843
  Gene Symbol: HYDIN
  Gene Name: HYDIN, axonemal central pair apparatus protein
  ENST ID: ENST00000542890
  CDS Start-End: 1-383

SEQ ID NO: 141603 - DNA, 525 bp, Homo sapiens; identical to SEQ ID NO: 141588
  Payload ID: 7843
  Gene Symbol: HYDIN
  Gene Name: HYDIN, axonemal central pair apparatus protein
  ENST ID: ENST00000538568
  CDS Start-End: 1-341

SEQ ID NO: 141604 - DNA, 592 bp, Homo sapiens; identical to SEQ ID NO: 141579
  Payload ID: 7843
  Gene Symbol: HYDIN
  Gene Name: HYDIN, axonemal central pair apparatus protein
  ENST ID: ENST00000546257
  CDS Start-End: 1-130

SEQ ID NO: 141605 - DNA, 2792 bp, Homo sapiens; identical to SEQ ID NO: 141578
  Payload ID: 7843
  Gene Symbol: HYDIN
  Gene Name: HYDIN, axonemal central pair apparatus protein
  ENST ID: ENST00000539447
  CDS Start-End: 1-455

SEQ ID NO: 141606 - DNA, 4479 bp, Homo sapiens; identical to SEQ ID NO: 141590
  Payload ID: 7843
  Gene Symbol: HYDIN
  Gene Name: HYDIN, axonemal central pair apparatus protein
  ENST ID: ENST00000378856
  CDS Start-End: 1-148

SEQ ID NO: 141607 - DNA, 2595 bp, Homo sapiens; identical to SEQ ID NO: 141583
  Payload ID: 7843
  Gene Symbol: HYDIN
  Gene Name: HYDIN, axonemal central pair apparatus protein
  ENST ID: ENST00000545230
  CDS Start-End: 1-1587

SEQ ID NO: 141608 - DNA, 3091 bp, Homo sapiens; identical to SEQ ID NO: 141584
  Payload ID: 7843
  Gene Symbol: HYDIN
  Gene Name: HYDIN, axonemal central pair apparatus protein
  ENST ID: ENST00000393552
  CDS Start-End: 1-2502

SEQ ID NO: 141609 - DNA, 554 bp, Homo sapiens; identical to SEQ ID NO: 141589
  Payload ID: 7843
  Gene Symbol: HYDIN
  Gene Name: HYDIN, axonemal central pair apparatus protein
  ENST ID: ENST00000546297
  CDS Start-End: 1-248

SEQ ID NO: 141610 - DNA, 1634 bp, Homo sapiens
  Payload ID: 7844
  Gene Symbol: HVCN1
  Gene Name: hydrogen voltage gated channel 1
  Uniprot ID: Q96D96
  ENST ID: ENST00000242607
  CDS Start-End: 182-1003
acggggcgggacgggctgggccggacctgctctgaggctcccagtcgcagcggtgaccgcgggcgggtggggcgccgggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctgga

SEQ ID NO: 141611 - DNA, 2189 bp, Homo sapiens
  Payload ID: 7844
  Gene Symbol: HVCN1
  Gene Name: hydrogen voltage gated channel 1
  Uniprot ID: Q96D96
  ENST ID: ENST00000356742
  CDS Start-End: 755-1576
ggtgaagaaaccaagacgcagagaggccaagccccttgccttgggtcacacagccaaaggaggcagagccagaactcacaaccaggtctgtgtcccctaagtcctcggatgcatcgtccctgccccgctgccctcccgggagattgtaggagagaagcaggggcagaggcagtgctggatgtcccgggagaaggctgcaatgagcaggcccagccatccctgaaggaggagccccggggaagcaaactcttccctagaaacactttaaaagcacccacctgttggagacagagatgctgaggaacaagagtgattggggccagggtaaacgccaagacagagaggggagagcagttcctcagtggaactccctccaacattgcccccaccacttttaccagtgctgggtgtgggggatcttgcaggctcagcttcgtgacttggcctgtctctgcctcagtttccgcatctgtcccatgaggttaagcatgtacctacctcgcaggattgctgagaagatgatataagatgcttggtgtacaggcttagcccctggcaccaggttactaccaaaagttcatggttccagtgcttcctccaccctccgtcctgcccctctgagagtacttctctgtcctgggcacctttaacttcaggttgttcagggctatctgagatctgcaggatttccggacagccccaccagcaactaggagctgcttgagtaagaccaagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaa

SEQ ID NO: 141612 - DNA, 1215 bp, Homo sapiens
  Payload ID: 7844
  Gene Symbol: HVCN1
  Gene Name: hydrogen voltage gated channel 1
  Uniprot ID: Q96D96
  ENST ID: ENST00000439744
  CDS Start-End: 177-938
cgtacgagttggcccggagcaaggcggcccaggacaggcaggggctgcacgcggtgaagaaaccaagacgcagagaggccaagccccttgccttgggtcacacagccaaaggaggcagagccagaactcacaaccaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggac

SEQ ID NO: 141613 - DNA, 539 bp, Homo sapiens
  Payload ID: 7844
  Gene Symbol: HVCN1
  Gene Name: hydrogen voltage gated channel 1
  ENST ID: ENST00000546713
  CDS Start-End: 305-539
gcttctttcccagcctgcctcctggaggtgaacatgtgcaggtggagaagtgcccactgcatcggggccaaaagagagaacgctgcctacctcaccccaacggcatttgaaagtagactggctcatctgaaatgcttatttgcaagcatctaacttcctgaccctgtgtcacagatggccccacttggccccaagcccctggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctg

SEQ ID NO: 141614 - DNA, 441 bp, Homo sapiens
  Payload ID: 7844
  Gene Symbol: HVCN1
  Gene Name: hydrogen voltage gated channel 1
  ENST ID: ENST00000547887
  CDS Start-End: 23-262
cagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtgg

SEQ ID NO: 141615 - DNA, 1301 bp, Homo sapiens
  Payload ID: 7844
  Gene Symbol: HVCN1
  Gene Name: hydrogen voltage gated channel 1
  Uniprot ID: Q96D96
  ENST ID: ENST00000548312
  CDS Start-End: 210-977
ggatttttgtgatccgcgattcgctcccacgggcgggacctttgtaactgcgggaggcccaggacaggcccaccctgcggggcgggaggcagccggggtgagggaggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaagcccctggactgatgagtttgctgtatcaacctgtaaggagaagctctctccggatggctatgggaatgaaagaatccgacttctactctcacacagccaccgtgaaagtcctggagtaaaatgtgctgtgtacagaagagagagaaggaagcaggctggcatgttcactgggctggtgttacgacagagaacctgacagtcactggccagttatcacttcagattacaaatcacacagagcatctgcctgttttcaatcacaagagaacaaaaccaaaatctataaagatattctgaaaatatgacagaatttgacaaataaaagcataaacgtgt

SEQ ID NO: 141616 - DNA, 829 bp, Homo sapiens
  Payload ID: 7844
  Gene Symbol: HVCN1
  Gene Name: hydrogen voltage gated channel 1
  ENST ID: ENST00000549442
  CDS Start-End: 188-829
gacttcagagctgggcctgcgcctgcggggccgtacgagttggcccggagcaaggcggcccaggacaggcaggggctgcacgcggtgaagaaaccaagacgcagagaggccaagccccttgccttgggtcacacagccaaaggaggcagagccagaactcacaaccagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaat

SEQ ID NO: 141617 - DNA, 1568 bp, Homo sapiens
  Payload ID: 7844
  Gene Symbol: HVCN1
  Gene Name: hydrogen voltage gated channel 1
  Uniprot ID: Q96D96
  ENST ID: ENST00000620084
  CDS Start-End: 23-844
cagatccagaggcaacagggacatggccacctgggacgaaaaggcagtcacccgcagggccaaggtggctcccgctgagaggatgagcaagttcttaaggcacttcacggtcgtgggagacgactaccatgcctggaacatcaactacaagaaatgggagaatgaagaggaggaggaggaggaggagcagccaccacccacaccagtctcaggcgaggaaggcagagctgcagcccctgacgttgcccctgcccctggccccgcacccagggccccccttgacttcaggggcatgttgaggaaactgttcagctcccacaggtttcaggtcatcatcatctgcttggtggttctggatgccctcctggtgcttgctgagctcatcctggacctgaagatcatccagcccgacaagaataactatgctgccatggtattccactacatgagcatcaccatcttggtcttttttatgatggagatcatctttaaattatttgtcttccgcctggagttctttcaccacaagtttgagatcctggatgccgtcgtggtggtggtctcattcatcctcgacattgtcctcctgttccaggagcaccagtttgaggctctgggcctgctgattctgctccggctgtggcgggtggcccggatcatcaatgggattatcatctcagttaagacacgttcagaacggcaactcttaaggttaaaacagatgaatgtacaattggccgccaagattcaacaccttgagttcagctgctctgagaaggaacaagaaattgaaagacttaacaaactattgcgacagcatggacttcttggtgaagtgaactagacccggaccagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagccttgtggaaggtccagtaccaccaagagctgcccatccactcccaccccacactgtatcaaatgtatcacattttctcatgttgaacactttagccttaattgaaaatgagcaacaaagctggacaattgctagttgtatataaaatttaatctcaccgaatgtacagttttcaaatttcacgtgtatattaaggaactgatgcatctgagcattctgaaagaaagaaaaagaagctactttagctgccaccccattctagaaaagtctcttattttcaagctgttctaaatagcttcgtctcagtttccccaaaaggggtacccaggcccctcctctgtgtgccccagctgcatcagccagcttctaggtggctccattgttttctgccacctgacaacatttttcctcaattactgtacaactactgtataaaataaaacaactactgtataaaataaactctctcttttccctggaccctcctactgtattctttcctctgtggcacccataccagcctgccagtcggagagcaagctagctacagtgcctggtgcagaaatggcaatt

SEQ ID NO: 141618 - DNA, 1810 bp, Homo sapiens
  Payload ID: 7845
  Gene Symbol: HYLS1
  Gene Name: hydrolethalus syndrome 1
  Uniprot ID: Q96M11
  ENST ID: ENST00000356438
  CDS Start-End: 535-1434
aatcctcacattttgggagggaggccaaggcgggcagatcacctgaggttaggagttcaagatcagcctggccaacatggcgaaaccctgtctctattaaaaataccaaaattagctgggcatggtggcacgcgcctgtaataccagctactcaggaggctgaggcaggagagtcacttgaacccgggaggcggaggctgcagtgagtcgagatcgtgccactgcactccagcctgggcgacaagagcgagactctgtctcaaaaaaaaaagagtggttaacaagcatgatgatacaaccagttgaaagcaatatttgagttcataaagaagttgatgagttgataaaccaacaacacctaattggggaaagcataaggaagagagctgtgttgcaatcaaaaggttttttttttacttgaatgtaaataccaatcaagatacattgaaataaggacctgaaggtggcaagacagtagaaagcaggagtaagagtggaaatgaaagcagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaatt

SEQ ID NO: 141619 - DNA, 2061 bp, Homo sapiens
  Payload ID: 7845
  Gene Symbol: HYLS1
  Gene Name: hydrolethalus syndrome 1
  Uniprot ID: Q96M11
  ENST ID: ENST00000425380
  CDS Start-End: 782-1681
gcagccacgggtcacgccagggccctgcacaccatgcagaggaaaggaagagctcagtgcgccagggtttcatacagccgctctctcaggccccaaggaaacgtctagagcgcacaggcggactcaccccagactgttcgaaccgtccctgagcgcccgccctcgtctcccggcaccactggccccgcagcagccagttgagaagggcggaggctgattccaatgaagtggcagaccgttaggcggcctctccaaaaagccagctatgtcgccgttagccaaggtttgagggtcttctccttctcttcgagggcccaacctcccctccagatttagtacaccagaggcgtcgcagcaacggctgctgcctgcgcgcctcagctaggcgggctcggatatttttaaggccacattggaaatcccgggcatgctcccgccggcggagaaggcccagacaaaatgtgcgccaatcaggatacagacttggaggacgtttaccctcaggaccaataagagggagggcggaccgggccaagggtgccggttcgctctccggatttaaacctcagcggtcggcggttaaccgcaggctcggcgcgtgggccggcagtgcgcctgcgcaagttacgcgaaagctaacagaatctgcggtgctctgctggcgactggcaggacgcggtgcagagagcggacttccgcgacgcgggttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattacacttaccaattaaagaattttggaaattcatg

SEQ ID NO: 141620 - DNA, 1803 bp, Homo sapiens
  Payload ID: 7845
  Gene Symbol: HYLS1
  Gene Name: hydrolethalus syndrome 1
  Uniprot ID: Q96M11
  ENST ID: ENST00000526028
  CDS Start-End: 555-1454
ccggaagcggagggacgcggggacctggtggctgccggcccactgcggcgggagccctcgctccttttcccaccgtcgggacggtgcagagtggcagcttccctccgtggattccaggtcctgcctggcgagccgtccccaacgtctgcgttcctgagggaggcggccggggcagcgtgagctacaggcgatgtgcgcggcgggccgcagcccctggaggtcacggtgtgcgctggccgccgccgcggtctttgccccggtggcctttctgagctcctgggccgcgcccctgggaccaggcggaggccggggacggccccagggctggaggggagtcccgaaggccgctagcgacctgggtccaagccacgcccacggccaggcggggcgactgcgagctttgccgttgaaaggcggagcgtgtcttgtcgccttctagctgcaccttttgtggactgcagcatggaaccgtccaaggtgttttttttttacttgaatgtaaataccaatcaagatacattgaaataagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtaagggccctttgtgtcctgtaactttttttacctatcaatatgagttgctgtgcttcagtgtgtgttttttaagttgctgggcattaca

SEQ ID NO: 141621 - DNA, 1777 bp, Homo sapiens
  Payload ID: 7846
  Gene Symbol: HAO1
  Gene Name: hydroxyacid oxidase (glycolate oxidase) 1
  Uniprot ID: Q9UJM8
  ENST ID: ENST00000378789
  CDS Start-End: 53-1165
ttaaaaaaaaaaaaacaacgaactccatctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaatata

SEQ ID NO: 141622 - DNA, 1417 bp, Homo sapiens
  Payload ID: 7847
  Gene Symbol: HAO2
  Gene Name: hydroxyacid oxidase 2 (long chain)
  Uniprot ID: Q9NYQ3
  ENST ID: ENST00000325945
  CDS Start-End: 74-1129
gccaggctttgagtggctgcgtctaaacacttctttccctgaggactggaagacattagaataaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactgg

SEQ ID NO: 141623 - DNA, 1668 bp, Homo sapiens
  Payload ID: 7847
  Gene Symbol: HAO2
  Gene Name: hydroxyacid oxidase 2 (long chain)
  Uniprot ID: Q9NYQ3
  ENST ID: ENST00000361035
  CDS Start-End: 284-1378
ggtgtgtttcctaacacctccggcagtgagccaggctttgagtggctgcgtctaaacacttctttccctgaggactggaagacattagaataagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 141624 - DNA, 691 bp, Homo sapiens
  Payload ID: 7847
  Gene Symbol: HAO2
  Gene Name: hydroxyacid oxidase 2 (long chain)
  ENST ID: ENST00000457318
  CDS Start-End: 133-691
ttctttagcctgaactgtgggtagtgatgtggtgtgtttcctaacacctccggcagtgagccaggctttgagtggctgcgtctaaacacttctttccctgaggactggaagacattagaataaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttc

SEQ ID NO: 141625 - DNA, 1696 bp, Homo sapiens
  Payload ID: 7847
  Gene Symbol: HAO2
  Gene Name: hydroxyacid oxidase 2 (long chain)
  Uniprot ID: Q9NYQ3
  ENST ID: ENST00000622548
  CDS Start-End: 353-1408
ttctttagcctgaactgtgggtagtgatgtggtgtgtttcctaacacctccggcagtgagccaggctttgagtggctgcgtctaaacacttctttccctgaggactggaagacattagaataagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactgg

SEQ ID NO: 141626 - DNA, 1912 bp, Homo sapiens
  Payload ID: 7848
  Gene Symbol: HADH
  Gene Name: hydroxyacyl-CoA dehydrogenase
  Uniprot ID: Q16836
  ENST ID: ENST00000309522
  CDS Start-End: 150-1094
ccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagcta

SEQ ID NO: 141627 - DNA, 2033 bp, Homo sapiens
  Payload ID: 7848
  Gene Symbol: HADH
  Gene Name: hydroxyacyl-CoA dehydrogenase
  ENST ID: ENST00000403312
  CDS Start-End: 43-1215
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagcta

SEQ ID NO: 141628 - DNA, 571 bp, Homo sapiens
  Payload ID: 7848
  Gene Symbol: HADH
  Gene Name: hydroxyacyl-CoA dehydrogenase
  ENST ID: ENST00000511742
  CDS Start-End: 79-237
agtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagagaattaatacaagtgtattctggatgatttgaatgtttcatcactaacgagatctgagatatccatccccttatgtgcatttgtgttcatattattatttgtgccaag

SEQ ID NO: 141629 - DNA, 2044 bp, Homo sapiens
  Payload ID: 7848
  Gene Symbol: HADH
  Gene Name: hydroxyacyl-CoA dehydrogenase
  ENST ID: ENST00000505878
  CDS Start-End: 274-1230
gtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 141630 - DNA, 2032 bp, Homo sapiens
  Payload ID: 7848
  Gene Symbol: HADH
  Gene Name: hydroxyacyl-CoA dehydrogenase
  Uniprot ID: Q16836
  ENST ID: ENST00000603302
  CDS Start-End: 220-1215
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagct

SEQ ID NO: 141631 - DNA, 1774 bp, Homo sapiens
  Payload ID: 7848
  Gene Symbol: HADH
  Gene Name: hydroxyacyl-CoA dehydrogenase
  ENST ID: ENST00000626637
  CDS Start-End: 1-957
atgtgtaggacagccttaggagttactacacttcaagacctgggtgtctgctggaggaaggaacatgaccctgcggagatgttaagggttgggagagctgagcttggaggctggaagcccagctgggaggctattgttaaagaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagct

SEQ ID NO: 141632 - DNA, 3037 bp, Homo sapiens
  Payload ID: 7849
  Gene Symbol: HADHA
  Gene Name: hydroxyacyl-CoA dehydrogenase/3-ketoacyl-CoA thiolase/enoyl-CoA hydratase (trifunctional protein), alpha subunit
  Uniprot ID: P40939
  ENST ID: ENST00000380649
  CDS Start-End: 131-2422
cggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctgttggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctgga

SEQ ID NO: 141633 - DNA, 752 bp, Homo sapiens
  Payload ID: 7849
  Gene Symbol: HADHA
  Gene Name: hydroxyacyl-CoA dehydrogenase/3-ketoacyl-CoA thiolase/enoyl-CoA hydratase (trifunctional protein), alpha subunit
  ENST ID: ENST00000492433
  CDS Start-End: 1-752
gagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaata

SEQ ID NO: 141634 - DNA, 2044 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  Uniprot ID: P55084
  ENST ID: ENST00000317799
  CDS Start-End: 105-1529
cctttctgggcaggacccgccccttggtcccgcagagccttggtacttggacctgaaccttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggagaa

SEQ ID NO: 141635 - DNA, 1588 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENST ID: ENST00000405867
  CDS Start-End: 74-1129
gcagagccttggtacttggacctgaaccttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaat

SEQ ID NO: 141636 - DNA, 696 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENST ID: ENST00000425035
  CDS Start-End: 170-696
acgtcagccaaggtgagacggcgagccctcagctctccgcccgggctttcccaaaggcgagattccacttccttccccgcaactgtcgccggtgcccccggccccctcccctccctgggaaagtgggagttgagggagcggaaggaaactcctcggacaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactc

SEQ ID NO: 141637 - DNA, 574 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENST ID: ENST00000412805
  CDS Start-End: 321-574
ctcggacaaggtcggcagtgctagctgcagttaggacagtgacttggactagcgttccagctgaagttcgggacagtagtgtcacctgcgccctaatttatcatcacaagttaacgaagtctgggggtgtgggggtgtgtgtgtgtgtgtgggtgtgtgtgggcgtgtgtgggcgtcggccttaatgtaaccctggtctgcgtagaagtgtgtgttgtttcgcctgcttcccctgtacccaggtcggcggctatagagattgtggacggcgccatgggtttgcccgatttctgctgtaaagaataagactagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttac

SEQ ID NO: 141638 - DNA, 557 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENST ID: ENST00000448743
  CDS Start-End: 109-557
aaagtaacacagctagtgactagaaccacgtgccctggctaccacttccgagtgacatcagctgccgatccataagaaataccttcaaaccaatgcagggattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttgg

SEQ ID NO: 141639 - DNA, 1870 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  Uniprot ID: P55084
  ENST ID: ENST00000545822
  CDS Start-End: 1-1359
atgacactggtttctggttggctcctatatggatggatcattgctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgg

SEQ ID NO: 141640 - DNA, 2142 bp, Homo sapiens
  Payload ID: 7850
  Gene Symbol: HADHB
  Gene Name: hydroxyacyl-CoA dehydrogenase/3-ketoacyl-CoA thiolase/enoyl-CoA hydratase (trifunctional protein), beta subunit
  ENST ID: ENST00000537713
  CDS Start-End: 252-1631
tcgctcctggctaacatggccgaaaggtcgtattctccgggggaggacgggggcccggagaggagggggtggagtgcctggttttccagtcaggcggccggagggcagccctcaagaacggccctgaccgcccgcggggtgaggggccctttctgggcaggacccgccccttggtcccgcagagccttggtacttggacctgaaccttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgg

SEQ ID NO: 141641 - DNA, 1257 bp, Homo sapiens
  Payload ID: 7851
  Gene Symbol: HAGH
  Gene Name: hydroxyacylglutathione hydrolase
  Uniprot ID: Q16775
  ENST ID: ENST00000397353
  CDS Start-End: 295-1077
gacgccggtgttttgcagtcctgggcagctcggcagtccagcccggcccgggtcatggtggtgggccgagggctgctcggccgccgcagcctcgccgcgctgggagccgcctgcgcccgccgaggcctcggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataa

SEQ ID NO: 141642 - DNA, 2984 bp, Homo sapiens
  Payload ID: 7851
  Gene Symbol: HAGH
  Gene Name: hydroxyacylglutathione hydrolase
  Uniprot ID: Q16775
  ENST ID: ENST00000397356
  CDS Start-End: 408-1334
agctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgctcccaggcccgtctcccggcccgtggcagtcggggctcgcggacaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataacttccccttgcagactgttttcttctggcctttaggcctctgcttgtcccctcgggcctccttcctcctccgtgagccactgcagtccccccacccacgcttcaggtcaggcgtgagccggtgcctttgctgtggccttggctgggtgctgatgggactgtcaggcccactgctgcggtcggtacctttgcagcctgtgcttgtggtctgatctgctcaggcccccggcagggagaggtggccgcgtcttcttcctggaggcggccagatcgcgcgacctccaggcagtgctcctactcggcagcacccacctgcctctgcttgagaaagcacaaaccgccctctggggaagcagccagctggggagtgctctcggcctgtgaccccgggagggctgggtaggtggccacatgtcctgccccggctctgggtgtggctggtggcagagggtctatgagggaagggcaggacaaaggcaacccctaaggctaatctgaaatttagggctgggcgtggtggctaagcctgtgatcccagcactttgggaggccgaggcgggtggatcacgaggtcaggagatcgagtccatcctggctaacatggtgaaaccccgtctctactaaaaatacaaaaaattagccaggtgtggtggcagacacctgtagtcccggctactcgggaggctaaggcaggagaatggtgtgaacccaggaggcggggcttgcagtgagccgagatagcgccactgcactccagcctgggagacagagcaagactctgtctcaaaaaaaaaaaaatatgaaatttaataataatctttttaaaaagttacctgggcagggtggtgtgcagctgtagtcctagctactcaggaggctgaggcaggaggatcgcttgagcccgggagtccaaggctgcagtgagcattgcttgtgccactgcattctggcttggggaacagggagaccctgtctcaaagaaattaattaatcatgcagttgagtggtatttagtccattcacaatgctgcagccgcctctcgcgtgttctgaaacatttgacctattcactgactgactgactgctctgtcagtgagctgtgaggggaggtgactctgtgtggggcccacaccctctgccacctggtcctatagacagactcttctgagtggaggggcagagcggccctgggacctaggagcaagcctggcccgaggcttgtggattgaagaggaaggctggcactgcacttcagaccacatgcatgccctccccccggaggggtcactggtctgttcgcatactcgcagacccctctgggatgccacggaagccaggcgtgtgtgaggaggcagggcagactgcttctccggctttcttctcccactacccccgccccagcgcaaagagtttgttctattgttcagcaaatattcttaggccagaatcttaaatgtttccattctataa

SEQ ID NO: 141643 - DNA, 1276 bp, Homo sapiens
  Payload ID: 7851
  Gene Symbol: HAGH
  Gene Name: hydroxyacylglutathione hydrolase
  Uniprot ID: Q16775
  ENST ID: ENST00000455446
  CDS Start-End: 48-758
gtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataacttccccttgcagactgttttcttctggcctttaggcctctgcttgtcccctcgggcctccttcctcctccgtgagccactgcagtccccccacccacgcttcaggtcaggcgtgagccggtgcctttgctgtggccttggctgggtgctgatgggactgtcaggcccactgctgcggtcggtacctttgcagcctgtgcttgtggtctgatctgctcaggcccccggcag

SEQ ID NO: 141644 - DNA, 864 bp, Homo sapiens
  Payload ID: 7851
  Gene Symbol: HAGH
  Gene Name: hydroxyacylglutathione hydrolase
  ENST ID: ENST00000564445
  CDS Start-End: 1-718
caaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttagaaatcagccagctaactagaaaatcggcaagagaccgaaaccagcagtggctgaggccagatgaccctgtggctgtgtgctggacaagatgctcggtctcc

SEQ ID NO: 141645 - DNA, 1291 bp, Homo sapiens
  Payload ID: 7851
  Gene Symbol: HAGH
  Gene Name: hydroxyacylglutathione hydrolase
  ENST ID: ENST00000566709
  CDS Start-End: 286-1062
ctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgctcccaggcccgtctcccggcccgtggcagtcggggctcgcggacaaaacaagtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagtggccctggctcctccggtgggcgtggctcggcacagcctgcagcccggtgctggcctccgcagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagttt

SEQ ID NO: 141646 - DNA, 820 bp, Homo sapiens
  Payload ID: 7851
  Gene Symbol: HAGH
  Gene Name: hydroxyacylglutathione hydrolase
  ENST ID: ENST00000569339
  CDS Start-End: 341-820
ggccgagggctgctcggccgccgcagcctcgccgcgctgggagccgcctgcgcccgccgaggcctcggtgggtgcggcggggcggtgcgggccgggggacgcgggcctggcggggcgggcagcgggcggcgccgggccgtcgtttggcgaccgctgacgcggtgtctgttgcgcaggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttg

SEQ ID NO: 141647 - DNA, 612 bp, Homo sapiens
  Payload ID: 7851
  Gene Symbol: HAGH
  Gene Name: hydroxyacylglutathione hydrolase
  ENST ID: ENST00000566644
  CDS Start-End: 1-195
ctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttagacagactcttctgagtggaggggcagagcggccctgggacctaggagcaagcctggcccgaggcttgtggattgaagaggaaggctggcactgcacttcagaccacatgcatgccctccccccggaggggtcactggtctgttcgcatactcgcagacccctctgggatgccacggaagccaggcgtgtgtgaggaggcagggcagactgcttctccggctttcttctcccactacccccgccccagcgcaaagagtttgttctattgttcagcaaatattcttaggccagaatcttaaatgtttccattctataacaaacactgtgctcatttgtcaaccaataagtaattttaacagccctctttggatg

SEQ ID NO: 141648 - DNA, 1701 bp, Homo sapiens
  Payload ID: 7852
  Gene Symbol: HAGHL
  Gene Name: hydroxyacylglutathione hydrolase-like
  Uniprot ID: Q6PII5
  ENST ID: ENST00000341413
  CDS Start-End: 282-1154
ggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccgcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggcccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 141649 - DNA, 1347 bp, Homo sapiens
  Payload ID: 7852
  Gene Symbol: HAGHL
  Gene Name: hydroxyacylglutathione hydrolase-like
  Uniprot ID: Q6PII5
  ENST ID: ENST00000389703
  CDS Start-End: 240-1088
gccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 141650 - DNA, 1820 bp, Homo sapiens
  Payload ID: 7852
  Gene Symbol: HAGHL
  Gene Name: hydroxyacylglutathione hydrolase-like
  Uniprot ID: Q6PII5
  ENST ID: ENST00000549114
  CDS Start-End: 304-912
ccgggcacgcgcaccgccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccgcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggcccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggccgttgtcagtgttggcaga

SEQ ID NO: 141651 - DNA, 663 bp, Homo sapiens
  Payload ID: 7852
  Gene Symbol: HAGHL
  Gene Name: hydroxyacylglutathione hydrolase-like
  ENST ID: ENST00000564545
  CDS Start-End: 249-503
gggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggggaccacgcgcggggaaacccggagctggcgcggcttcgtcccgggctggcggtgctgggcgcggacgagcgcatcttctcgctgacgcgcaggctggcgcacggcgaggagctgcggaaggtgttctgcggccacgagcacacgcttagcaacctggagtttgcccagaaagtggagccctgcaacgaccacgtgagagccaagctgtcctgggctaaggcacggcccctttcccgccgcggcaagagggtggggggggagggaacaggcttcggggtggggggggctctcagacaaggcctaatggtg

SEQ ID NO: 141652 - DNA, 740 bp, Homo sapiens
  Payload ID: 7852
  Gene Symbol: HAGHL
  Gene Name: hydroxyacylglutathione hydrolase-like
  ENST ID: ENST00000568141
  CDS Start-End: 165-740
ggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagac

SEQ ID NO: 141653 - DNA, 493 bp, Homo sapiens
  Payload ID: 7852
  Gene Symbol: HAGHL
  Gene Name: hydroxyacylglutathione hydrolase-like
  ENST ID: ENST00000563792
  CDS Start-End: 170-493
gtttatcttggggctccctgaagttacggcacctctggcctccgccctttcgctgctgcctggcggtccctgcacgcgctgggcgcagtcaccgcccgctgggtccccgctccccggcgctccccggggctctggccggcctggggcagtgagcgcggcggatcccgatatggagggagtgggccaccgggaccgtctgtgttaccgtcactcccgtccctttcagctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgc

SEQ ID NO: 141654 - DNA, 1041 bp, Homo sapiens
  Payload ID: 7852
  Gene Symbol: HAGHL
  Gene Name: hydroxyacylglutathione hydrolase-like
  ENST ID: ENST00000561546
  CDS Start-End: 265-948
gactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggctt

SEQ ID NO: 141655 - DNA, 650 bp, Homo sapiens
  Payload ID: 7852
  Gene Symbol: HAGHL
  Gene Name: hydroxyacylglutathione hydrolase-like
  ENST ID: ENST00000562141
  CDS Start-End: 51-650
ggtcctcagcacagccgtgccgcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaag

SEQ ID NO: 141656 - DNA, 1667 bp, Homo sapiens
  Payload ID: 7852
  Gene Symbol: HAGHL
  Gene Name: hydroxyacylglutathione hydrolase-like
  Uniprot ID: Q6PII5
  ENST ID: ENST00000564537
  CDS Start-End: 169-777
agtctgtccttcgggtcctcagcacagccgtgccggtgaggcgggcggcgggggaacgcggctgtcccggcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggcccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 141657 - DNA, 434 bp, Homo sapiens
  Payload ID: 7852
  Gene Symbol: HAGHL
  Gene Name: hydroxyacylglutathione hydrolase-like
  ENST ID: ENST00000561561
  CDS Start-End: 1-285
ggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtgg

SEQ ID NO: 141658 - DNA, 440 bp, Homo sapiens
  Payload ID: 7852
  Gene Symbol: HAGHL
  Gene Name: hydroxyacylglutathione hydrolase-like
  ENST ID: ENST00000569385
  CDS Start-End: 1-65
ctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgg

SEQ ID NO: 141659 - DNA, 100 bp, Homo sapiens
  Payload ID: 7852
  Gene Symbol: HAGHL
  Gene Name: hydroxyacylglutathione hydrolase-like
  ENST ID: ENST00000562187
  CDS Start-End: 61-100
agtctgtccttcgggtcctcagcacagccgtgccggcaccggtggccgagctccgtgaccatgaaggtcaaggtcatccccgtgctcgaggacaactaca

SEQ ID NO: 141660 - DNA, 735 bp, Homo sapiens
  Payload ID: 7852
  Gene Symbol: HAGHL
  Gene Name: hydroxyacylglutathione hydrolase-like
  ENST ID: ENST00000567414
  CDS Start-End: 218-735
ccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacggtgagcgggcctgggccctc

SEQ ID NO: 141661 - DNA, 888 bp, Homo sapiens
  Payload ID: 7853
  Gene Symbol:
  Gene Name: Hydroxyacyl-thioester dehydratase type 2, mitochondrial  [Source:UniProtKB/Swiss-Prot
  Acc:P86397]
  ENST ID: ENST00000474660
  CDS Start-End: 660-888
gggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggctggagtgcaatggcacgatcttggctcaccgcaccctccgcctcccaggttcaagcgattctcctgcctcagcctcgcaagtagctgggattacaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacacca

SEQ ID NO: 141662 - DNA, 847 bp, Homo sapiens
  Payload ID: 7853
  Gene Symbol:
  Gene Name: Hydroxyacyl-thioester dehydratase type 2, mitochondrial  [Source:UniProtKB/Swiss-Prot
  Acc:P86397]
  ENST ID: ENST00000476007
  CDS Start-End: 633-847
tggtgaatatatttaataccagtctgtacaaaataatttcccaggtatcctctcctttaatgtcagaacagcctgcagagggcagtgctgtcatttgtaagtctttttttttttttttaattgcaaaaaatacgtgacataaaatttatcgtaagtagcattgagtacattcacaacgctgtgcagccatcaccactgtccatctcgtgaatgttgtagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactt

SEQ ID NO: 141663 - DNA, 1531 bp, Homo sapiens
  Payload ID: 7853
  Gene Symbol:
  Gene Name: Hydroxyacyl-thioester dehydratase type 2, mitochondrial  [Source:UniProtKB/Swiss-Prot
  Acc:P86397]
  Uniprot ID: P86397
  ENST ID: ENST00000477305
  CDS Start-End: 661-1167
gggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggctggagtgcaatggcacgatcttggctcaccgcaccctccgcctcccaggttcaagcgattctcctgcctcagcctcgcaacattattccatatgcaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaacc

SEQ ID NO: 141664 - DNA, 648 bp, Homo sapiens
  Payload ID: 7853
  Gene Symbol:
  Gene Name: Hydroxyacyl-thioester dehydratase type 2, mitochondrial  [Source:UniProtKB/Swiss-Prot
  Acc:P86397]
  ENST ID: ENST00000475412
  CDS Start-End: 487-648
acgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggct

SEQ ID NO: 141665 - DNA, 1378 bp, Homo sapiens
  Payload ID: 7853
  Gene Symbol:
  Gene Name: Hydroxyacyl-thioester dehydratase type 2, mitochondrial  [Source:UniProtKB/Swiss-Prot
  Acc:P86397]
  Uniprot ID: P86397
  ENST ID: ENST00000481972
  CDS Start-End: 520-1026
tctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaa

SEQ ID NO: 141666 - DNA, 1508 bp, Homo sapiens
  Payload ID: 7853
  Gene Symbol:
  Gene Name: Hydroxyacyl-thioester dehydratase type 2, mitochondrial  [Source:UniProtKB/Swiss-Prot
  Acc:P86397]
  Uniprot ID: P86397
  ENST ID: ENST00000461393
  CDS Start-End: 548-1054
gtcctctccgaccccgggcgctgagggcctctgtacggcgccgcgtagggtctcggccgcagaacgtggccgagaggcccgggcgagacttcgggaccgtgtcctgagcgctctccatgcgcccggcgcgagagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctga

SEQ ID NO: 141667 - DNA, 4768 bp, Homo sapiens
  Payload ID: 7854
  Gene Symbol: HCAR1
  Gene Name: hydroxycarboxylic acid receptor 1
  Uniprot ID: Q9BXC0
  ENST ID: ENST00000432564
  CDS Start-End: 505-1545
aatgtttggatttctccaccaggagggaggacaaacaagctttcttcttgccttctgggcagctttgtgtgctctccagcacggagtccgaggaggaacagcgaagctgaaaatgaaaattactctggcgctggacccaatcgctcctctacggcatcaatctcatcggacccccccaccctaccgcctctcagaaatgaccacttttgcaaaattgcatgcatttccaagcttcatccggctccaggcttggcctctcccagaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcctggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaattattcacttattttccaagtatttactgaattcgtatttggtggcaggcagtatactgtgtaatttttagtggagggtcattagtcaactcttatgtgacagtaaagttttttgggggggtggggacagagaagttaagagctttcatcctttcacggaatacagtttctagaccgattctgtgtgaacatcagttttgtcctcttattgcaagactccctcatacacatgagtttcccaaatgtgtacctggacccctcgaaacagaggactctacgaaatgacaagctgcccctgccctgaattagggggaaacattccaggccaactctagctcctttctcaagctacaaagtggtgaacatggttctcaactccttaatttatactctctcaaatgcccaggatactctacccacttaagaaccttgccaacttctgggggttgggcatggtggctcacgcttgtgatcccagcactttgggagactgaggcggatcacctgaggtcaggagttctagaccagcctgaccaacatggagaaacctcgtctctactaaaaattcaaaattagcctggtgtggtggcgcatgcctataatcccagctattcgggaggctgaggcaggagaatcacttgaaccgaggaggtggaggttgcggtgaggtgacatcgtgccattgcactccagactgggccacaggagtgaaacgccgtctcaaaaaaaaaaaagaactttgccaacttctagttctttggcctcaaaacacccctctaggctgtccctattattccttttttcagaggcactgtgcagcctagtgatgaaaagtacgagctatagagcattagaagcatcgaagtttgaatctcagctcaagcatttactaggcctgtgatcttagggcagcttgtgtttttagacactgaatcttgctctgttgcccaggctggagtgcagtgagtggcatgatcatagctcactgcagcctcaaactcctgggctcaagtgttcctcccacctcagcctcctgaatagctgggagtacaggcataagccaccacactcagctaatttttaaattttttttatagagacgaggtctcactcactgtgttgcccaagctggtctcaaactcctggcctccagcaatcctcccaccttggcctcccaaagtattgcgattgccagcatgagccactgctcccagcctggcatatatatagatatatatagagatatatagatatctatctatctatatatatatatatttttttttttttttttgagacagagtcttgctctatcacccaggctggagtacagtggcccaatctcagctcactgcaagctctgcctcctgggtccacgccattctcctgcctcagcctccagagtagctgggactacgggcgccccaccaccacgcccggctaattttttgtatttttagtacagacggggtttcattgtgttagccgggatggtcttgatctcctgacttgtgatccgcctgcctcggcctcccaaagtgcttggattacaggtgtaagccaccgcaccccgcccagcctggcagattttatttaatcatttgtagcttcattttcctcgtctgtcaaacagggatactgtaatacaacctcagtgtgtcattgggcagtttaaatgaatgtacattcctgaggcatcagaactttgttcactgttatatacccaatgcctagaagaggacctgcacatagcaggtgctcagtaaatgtttgttgaatgaatgattaagtgcatgtaaagcattaagcatagcgcctggcagtaagtgctcaatattatgacttcttatattaacacgttttacatataaagaaatggaggcaagaaagcatttcctttggggtttagagcgcttaagttgttcctctgttatcatgcctgaattcccccgcccctcagttacctggggaagagtaaaggcaagaattcttaccagcattagtcatacatcctcctgataggaatctgcgaaaacacacacttctgcttttagttctattcttagaattctctcctgggctgttgctcctttgttccttcattgtaataaaaatggattctgaaagcaaa

SEQ ID NO: 141668 - DNA, 2051 bp, Homo sapiens
  Payload ID: 7855
  Gene Symbol: HCAR2
  Gene Name: hydroxycarboxylic acid receptor 2
  Uniprot ID: Q8TDS4
  ENST ID: ENST00000328880
  CDS Start-End: 61-1152
cacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatgcgatttagggaaacggtggcagatgagtgggagactggttgcaaggtgtgaccgcaggaatcctggaggaatagagagtaaagcttctaggcatctgaaacttttgcttcatctctgacgctcgcaggactgaagatgggcaaattgtaggcatttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgctcctggagggagcccaggcatcattaaacaagccagtaggtcacctggcttccgtggaccaattcatctttcagacaagctttagcagaaatggactcagggaagagactcacacgctttggttaatatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgggcagttaaaacggcttcaggatagaaagctgtttcccacctctgtttgcttttaacattaaaagggaaatgtgcctctgccccacagttagaggggtgcacgttcctcctggttccttcgcttgtgtttctgtacttaccaaaaatctaccatttcaataaattttgataggagaca

SEQ ID NO: 141669 - DNA, 2137 bp, Homo sapiens
  Payload ID: 7856
  Gene Symbol: HCAR3
  Gene Name: hydroxycarboxylic acid receptor 3
  Uniprot ID: P49019
  ENST ID: ENST00000528880
  CDS Start-End: 156-1319
ttcgtagtttcctgataaccattcagtcatctatttcaacaccctgacatgacataaaggcaggcacggaaccacacgttcaccatacagacacacgccactttgctggagcattcactaggcgaggcgctccatcggactcactagctgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaagtttggggacatcccttgccggctggtgctcttcatgtttgccatgaaccgccagggcagcatcatattcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggcactgcaaatgtgtgcatcagcttcagcatctgccataccttccggtggcacgaagctatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccacatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagataacaggtgagccagataataaccgcagcacgagcgtcgagctcacaggggaccccaacaaaaccagaggcgctccagaggcgttaatcgccaactccggtgagccatggagcccctcttatctgggcccaacctcaaataaccattccaagaagggacattgtcaccaagaaccagcatctctggagaaacagttgggctgttgcatcgagtaatgtcactggactcggcctaagatttcctggaacttccagattcagagaatctgatttagggaaactgtggcagatgagtgggagactggttgcaaggtgtgaccgcaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgttcctggaggaagcccaggcatcattaaacaagccagtaggtcacctggcttccgtggaccaattcatctttcagacaatctttagcagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgaacagttaaaacggcttcaggatagaaagctgtttcccacctgtttgcttttaccattaaaagggaaacgtgcctctgccccacgggtagaggggtgcacgttcctcctggttccttcgcttgtgtttctgtacttaccaaaaatctaccatttcaataaattttgataggagaca

SEQ ID NO: 141670 - DNA, 1676 bp, Homo sapiens
  Payload ID: 7857
  Gene Symbol: HSD3B1
  Gene Name: hydroxy-delta-5-steroid dehydrogenase, 3 beta- and steroid delta-isomerase 1
  Uniprot ID: P14060
  ENST ID: ENST00000369413
  CDS Start-End: 146-1267
aggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatctggcgtataagccactctacagctgggaggaagccaagcagaaaacggtggagtgggttggttcccttgtggaccggcacaaggagaccctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaa

SEQ ID NO: 141671 - DNA, 1436 bp, Homo sapiens
  Payload ID: 7857
  Gene Symbol: HSD3B1
  Gene Name: hydroxy-delta-5-steroid dehydrogenase, 3 beta- and steroid delta-isomerase 1
  Uniprot ID: P14060
  ENST ID: ENST00000528909
  CDS Start-End: 160-1281
gtttgcaaaaaaaatggggtggaggaaaatgaggcatctgtgtgagtatataaccatttgacatctctttttagccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatctggcgtataagccactctacagctgggaggaagccaagcagaaaacggtggagtgggttggttcccttgtggaccggcacaaggagaccctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatc

SEQ ID NO: 141672 - DNA, 352 bp, Homo sapiens
  Payload ID: 7857
  Gene Symbol: HSD3B1
  Gene Name: hydroxy-delta-5-steroid dehydrogenase, 3 beta- and steroid delta-isomerase 1
  ENST ID: ENST00000531340
  CDS Start-End: 108-352
gccacaggaaatgaggtgagaaccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacac

SEQ ID NO: 141673 - DNA, 1741 bp, Homo sapiens
  Payload ID: 7858
  Gene Symbol: HSD3B2
  Gene Name: hydroxy-delta-5-steroid dehydrogenase, 3 beta- and steroid delta-isomerase 2
  Uniprot ID: P26439
  ENST ID: ENST00000369416
  CDS Start-End: 209-1327
gttcaaggtaataagggctgagacacaagccacagagcataaagctccagtccttcctccagggatgaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaacatgga

SEQ ID NO: 141674 - DNA, 717 bp, Homo sapiens
  Payload ID: 7858
  Gene Symbol: HSD3B2
  Gene Name: hydroxy-delta-5-steroid dehydrogenase, 3 beta- and steroid delta-isomerase 2
  ENST ID: ENST00000433745
  CDS Start-End: 131-717
tggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccatt

SEQ ID NO: 141675 - DNA, 1783 bp, Homo sapiens
  Payload ID: 7858
  Gene Symbol: HSD3B2
  Gene Name: hydroxy-delta-5-steroid dehydrogenase, 3 beta- and steroid delta-isomerase 2
  Uniprot ID: P26439
  ENST ID: ENST00000543831
  CDS Start-End: 250-1368
aaggctaaagccaagactctttatcacactgtggccttaagattggatttctcttcctgttcctgggaagaattagagatataacctaaaggtcactattattctgagaaaagggattctggaggaggagggagcaatgagtatgtggcaggagttcaagccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagcctgccaggacgtctcggtcgtcatccacaccgcctgtatcattgatgtctttggtgtcactcacagagagtccatcatgaatgtcaatgtgaaaggtacccagctactgttggaggcctgtgtccaagccagtgtgccagtcttcatctacaccagtagcatagaggtagccgggcccaactcctacaaggaaatcatccagaacggccacgaagaagagcctctggaaaacacatggcccactccatacccgtacagcaaaaagcttgctgagaaggctgtgctggcggctaatgggtggaatctaaaaaatggtgataccttgtacacttgtgcgttaagacccacatatatctatggggaaggaggcccattcctttctgccagtataaatgaggccctgaacaacaatgggatcctgtcaagtgttggaaagttctctacagtcaacccagtctatgttggcaacgtggcctgggcccacattctggccttgagggctctgcgggaccccaagaaggccccaagtgtccgaggtcaattctattacatctcagatgacacgcctcaccaaagctatgataaccttaattacatcctgagcaaagagtttggcctccgccttgattccagatggagccttcctttaaccctgatgtactggattggcttcctgctggaagtagtgagcttcctactcagcccaatttactcctatcaaccccccttcaaccgccacacagtcacattatcaaatagtgtgttcaccttctcttacaagaaggctcagcgagatctggcgtataagccactctacagctgggaggaagccaagcagaaaaccgtggagtgggttggttcccttgtggaccggcacaaggagaccctgaagtccaagactcagtgatttaaggatgacagagatgtgcatgtgggtattgttaggaaatgtcatcaaactccacccacctggcttcatacagaaggcaacaggggcacaagcccaggtcctgctgcctctctttcacacaatgcccaacttactgtcttcttcatgtcatcaaaatctgcacagtcactggcccaaccagaactttctgtcctaatcatacaccagaagacaaacaatatgatttgctgttaccaaatctcagtggctgattctgaacaattgtggtctctcttaacttgaggttctcttttgactaatagagctccatttcccctcttaaatgagaaagcatttcttttctctttaatctcctattccttcacacagttcaacataaagagcaataaatgttttaatgcttaacatggag

SEQ ID NO: 141676 - DNA, 2200 bp, Homo sapiens
  Payload ID: 7859
  Gene Symbol: HSD3B7
  Gene Name: hydroxy-delta-5-steroid dehydrogenase, 3 beta- and steroid delta-isomerase 7
  Uniprot ID: Q9H2F3
  ENST ID: ENST00000262520
  CDS Start-End: 291-881
agcggaaggacggtgtgcgggccggccagccctggacgaaagaagagggcccctccaggccagtctgggcaccctgggatagcggctgcagcccgcccctctctccgtaactcagccatcagcaggggcagacggcaggtggcctggttgctgcagctcccaggatcagctctgccctccccgcaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacg

SEQ ID NO: 141677 - DNA, 2172 bp, Homo sapiens
  Payload ID: 7859
  Gene Symbol: HSD3B7
  Gene Name: hydroxy-delta-5-steroid dehydrogenase, 3 beta- and steroid delta-isomerase 7
  Uniprot ID: Q9H2F3
  ENST ID: ENST00000297679
  CDS Start-End: 94-1203
gaaggacggtgtgcgggccggccagccctggacgaaagaagagggcccctccaggccagtctgggcaccctgggatagcggctgcagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggtccgtggggggctgcccctggtgacgtgtgcccttcgtcccacgggcatctacggtgaaggccaccagatcatgagggacttctaccgccagggcctgcgcctgggaggttggctcttccgggccatcccggcctctgtggagcatggccgggtctatgtgggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 141678 - DNA, 746 bp, Homo sapiens
  Payload ID: 7859
  Gene Symbol: HSD3B7
  Gene Name: hydroxy-delta-5-steroid dehydrogenase, 3 beta- and steroid delta-isomerase 7
  ENST ID: ENST00000574447
  CDS Start-End: 217-746
acggtgtgcgggccggccagccctggacgaaagaagagggcccctccaggccagtctgggcaccctgggatagcggctgcagctcccaggatcagctctgccctccccgcaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaa

SEQ ID NO: 141679 - DNA, 746 bp, Homo sapiens
  Payload ID: 7859
  Gene Symbol: HSD3B7
  Gene Name: hydroxy-delta-5-steroid dehydrogenase, 3 beta- and steroid delta-isomerase 7
  ENST ID: ENST00000562932
  CDS Start-End: 90-746
gacggtgtgcgggccggccagccctggacgaaagaagagggcccctccaggccagtctgggcaccctgggatagcggctgcagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacaggttcttgttgggggagcttgtggtggagagggtgtggacgcttccccaacccttcccaagctgggatccccacccctgcagtggaacagatgatgctggtttctgtccacatggatgggtcgaggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggtg

SEQ ID NO: 141680 - DNA, 1235 bp, Homo sapiens
  Payload ID: 7860
  Gene Symbol: HYKK
  Gene Name: hydroxylysine kinase
  Uniprot ID: A2RU49
  ENST ID: ENST00000388988
  CDS Start-End: 114-1235
gcgggcgctgcggcccctgctctacctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtatcaatcacggagatcttaatgaccataatattttaatagagtccagcaagtcagcctctggaaatgctgaatatcaagtgtctgggattttagactttggtgacatgagctatggctactatgtgtttgaagtggcaattaccatcatgtacatgatgattgagagcaagagtcctatacaagtaggaggccatgtccttgcagggtttgaaagcatcaccccactgacagctgtagagaagggtgctttgtttttacttgtatgcagtcgtttttgtcagtcacttgtcatggctgcatactcttgccagctatacccagagaacaaagactatctcatggttactgcaaaaaccgggtggaaacacttacagcaaatgtttgacatgggtcagaaagctgtagaagaaatctggtttgaaactgccaaatcctatgaatctgggatctccatgtga

SEQ ID NO: 141681 - DNA, 847 bp, Homo sapiens
  Payload ID: 7860
  Gene Symbol: HYKK
  Gene Name: hydroxylysine kinase
  Uniprot ID: A2RU49
  ENST ID: ENST00000408962
  CDS Start-End: 114-776
gcgggcgctgcggcccctgctctacctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgacctagcaccgtgccaggcccctagaagacccagtaaagatctgttgaataaactgtaagaatgaacacacc

SEQ ID NO: 141682 - DNA, 734 bp, Homo sapiens
  Payload ID: 7860
  Gene Symbol: HYKK
  Gene Name: hydroxylysine kinase
  Uniprot ID: A2RU49
  ENST ID: ENST00000563233
  CDS Start-End: 1-663
atgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgacctagcaccgtgccaggcccctagaagacccagtaaagatctgttgaataaactgtaagaatgaacacacc

SEQ ID NO: 141683 - DNA, 4097 bp, Homo sapiens
  Payload ID: 7860
  Gene Symbol: HYKK
  Gene Name: hydroxylysine kinase
  Uniprot ID: A2RU49
  ENST ID: ENST00000569878
  CDS Start-End: 1-1122
atgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtatcaatcacggagatcttaatgaccataatattttaatagagtccagcaagtcagcctctggaaatgctgaatatcaagtgtctgggattttagactttggtgacatgagctatggctactatgtgtttgaagtggcaattaccatcatgtacatgatgattgagagcaagagtcctatacaagtaggaggccatgtccttgcagggtttgaaagcatcaccccactgacagctgtagagaagggtgctttgtttttacttgtatgcagtcgtttttgtcagtcacttgtcatggctgcatactcttgccagctatacccagagaacaaagactatctcatggttactgcaaaaaccgggtggaaacacttacagcaaatgtttgacatgggtcagaaagctgtagaagaaatctggtttgaaactgccaaatcctatgaatctgggatctccatgtgactgagatctccatgtgactcaaagttcactttaacttgggtaattaaaataggacccagtcaaattttaggaaggattttcctgcatagttaaaaatcaactgatggaatggatcaattctgaatatgacagagcacatgaaatccctaaggtcttcaagcaatctcgtgacaattttttaaaattcacaaaagtaccacaagcaagcatatttttctgtgagtcttacttgccatatctataaaacacatataatgataccattttgaagcagataatctcacaagatctattcctgccctgagattaatgactattttaattttaaaaataatatatacatatagatatattgacatattttaaatatctggacataacatactgacctagataacatactaccagttctatgaaacctcctctgatctctcctttctctagaatcccagtgcattgtgtctttttcatggcccatcactttgtataatggatcgtggttgtgcagtcatcttgcctgagagctactgagggcggagaccatgtaaaacttatttttgtctcctcagcccttcttttttttttttttttttttttgagacggagtctcgctctgtcgcccaggctggagtgcagtggcacgatctcggctcattgcaagctccgcttctcgagttcacgccattctcctgcctcagcctcctgagtagctgggactacaggcgcccaccaccacgcccggctaattttttttgtatttttagtagagacagggtttcaccgtgttagccagaatggtctcgatctcctgaccttgtgatccacccgcctcgatctcccaaagtgctgggattacaggcatgagtcaccgtgcccggcctcctcatcccttcttatcacacctgctattatagtgcctttcctacagagaggtctttaaaaatatttgaaaataaatgcgtgctagaagaagggatggagaaggcacacactaagatgctttaggagaaagcattgacagcattcttggagaaaaaattttaacttgtctgagagggtggttgaaactggaactccagagatagatgctggaagaccctgggaactgcaaggaagcaaataatgacatccaggcaaggccactaacccctgagctacttaaatataatggttcctttcagactgataccaggaacctccttaagcatataagcatatattttttaattctctataatctgtttctttttggatgactatgaagtagattgggtagactgaagctcactgtattcttggctgacggtatcccactgtgtttccttcactggtttctcgtcatgtctcctttagtatgatttagtaaatggctgtttactattcttatgatttcaactattcattgtctacagatgactcaagtctagaaccctggccattcaaatactcaatagttatctttctatatatatgaacaggcattgatcctatctccatctttctgtctacctacctagtcttcccaaactagatatttctctaaattgtcttatatggttcatttttcacttctttgtccctcaatttcatttcatttctttttcttttcttttcttttctttttttttttttttggtggtggggcggcagggacagggtttcactgcagcctcaacctcctaggctcaggtgatcctcccacctcagcctccctagtagctgggacttcaggcatgtgccaccatgtctggctaattctttaattttttgtagagattggggtaatacctatctcatagaattaatagagttcattgtgaagatttcataagagaacagtgccaagtgcttaacacagtgtgtggcacatagttaggactcagtaactatttactcaataaatgaaccatattccaggttacccaaactcaaaatattggagtaattttttgcttgcctctcttatattcagtgagccctactggtttttagaattgtagaattttaggaatctctgtctttactggattttttgtttgttttgggcttttttgtttgtttgtttgagatagggtctcactccgtcaccgacgctggagtgcagtggtgtgatcacagctcactgcaacctctacctcctgggctcaagcaatcctcccacctcagcctcctgagtagctgggactacaggcatgtgccaccatgcccaactaatttattttattttgtagagatagggtctcactatgttgcccaggctggtctcaaacccctggactcaagcaatcctcctgccttggcctccctaaatgctaggattataggcgtgagctatcatacccagcctgtgttgttttttaacaatatataataaaagccaacatttattcagcactgaagtattttatacacattagctcacttaatttttacaacaaacctgtgtgggaagtactgttataattaatcgtcattttcagataagaaaatagcagctgaaaaagtaaaaataatttcctcaaagacagccagggcttaaatcaggcctttctgatgtagaccatgctcttcactaccacagagttccatgctactttctctccctctccctcctctcctgtccctgctacacacacacacacacacacacacacacacacatgcacactcactcacacacactaggaggaacaaatgagatcattcacatgaaagcacttatgtttctgaaatttaagggactgtggtttttatctaggttgacctctcaagctaaaaactgggaaccagaataatggactgaaacttgggtttcacttccagaccagtgttgatcctctgaattgatgaaactgtatagatttccctcttgattgcccctgctaacatggatttcctttcactcaattcctaatgcaaatattgctgaccactgtttagatgtttacatgctgcattacattgatattttacta

SEQ ID NO: 141684 - DNA, 2180 bp, Homo sapiens
  Payload ID: 7860
  Gene Symbol: HYKK
  Gene Name: hydroxylysine kinase
  Uniprot ID: A2RU49
  ENST ID: ENST00000566289
  CDS Start-End: 96-614
gctctacctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcaggagggtaagccccgcgttacacccctattggccaaaaactgaagaccaggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtgagtattctcccaattaagtatttttcttgatatttaaactgtccaatttcatatcatcagaaaagtatggaggtacaatttagctttatcaaatcttaaaattttgccatatttgctcctattgctttttaaataataatatttttactttcctcaaaattgctacatttgaagcctcctctaaactttacatgagtctacctctcttcttcccattaaatttgcacattacatatgtatgatttataaattatttatagtagggtttgtgtttttcaaactttatatcaatggtatcacactgtgtattattattctgcaacctgccttttctattcagcatgttttgcagattgatccatatgaatatttgtagttttaatttagtttattagttttaactgctaaatagtattccatagtatgaatataccataatttatttgcatgtactataattttttggtccattctcttgttaatggaattttaggttgcttcccatttctttgctacataaattatgctgcaatgaaccctctagtacaggagtccccaaaccccaggaactgggccacacagcaggaggtgagcagagggaaagcaagcattactgcctgagctctgcctcctgtcaaatcagcagcagcatttgattctcataggagcacaaaccctactgtgaactgcgcatgcaagggatctaagtgagaatctaatgcctgatgatctgagatgaaacagttttatcccaaaaccatccttccgctgtctcctgtccatggaaaaattgtcttccatgaaaccagtccctgatgccaaaaaggttgggaactactgctctagtatatatctatctccctgtgtacacagacaggtgtttctctaggctatatttctagatataaccagccttttcatccagcattaagtactggtcaaaggcaaggaactggctgggtgtggtggctcccgcctgtaatcccagcactttgggaggccgaggtgggtggatcacttgaggtcaggagtttgagactagcctggccaacgtggtgaaaccctgtttctaataaaaatgcaaaaactagctgggcatggtgacgcgtgcctgtaatctcagctactcagaggctgaggcagaagaattgcttgaaccctagaggtggaggttgcagtgggcctaggttgtgccactgcactccagcctgggcaacagagcgaaatccgtctcc

SEQ ID NO: 141685 - DNA, 1422 bp, Homo sapiens
  Payload ID: 7860
  Gene Symbol: HYKK
  Gene Name: hydroxylysine kinase
  ENST ID: ENST00000566332
  CDS Start-End: 61-741
gcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtgagtattctcccaattaagtatttttcttgatatttaaactgtccaatttcatatcatcagaaaagtatggaggtacaatttagctttatcaaatcttaaaattttgccatatttgctcctattgctttttaaataataatatttttactttcctcaaaattgctacatttgaagcctcctctaaactttacatgagtctacctctcttcttcccattaaatttgcacattacatatgtatgatttataaattatttatagtagggtttgtgtttttcaaactttatatcaatggtatcacactgtgtattattattctgcaacctgccttttctattcagcatgttttgcagattgatccatatgaatatttgtagttttaatttagtttattagttttaactgctaaatagtattccatagtatgaatataccataatttatttgcatgtactataattttttggtccattctcttgttaatggaattttaggttgcttcccatttctttgctacataaattatgctgcaatgaaccctctagtacaggagtccccaaaccccaggaactgggccacacagcaggaggtgagcagagggaaagcaagcattactgcctgagctctgcctcctgtcaaatcagcagcagcatttgattctcataggagcacaaaccctactgtgaactgcgcatgcaa

SEQ ID NO: 141686 - DNA, 1501 bp, Homo sapiens
  Payload ID: 7861
  Gene Symbol: HMBS
  Gene Name: hydroxymethylbilane synthase
  Uniprot ID: P08397
  ENST ID: ENST00000278715
  CDS Start-End: 152-1237
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggt

SEQ ID NO: 141687 - DNA, 1411 bp, Homo sapiens
  Payload ID: 7861
  Gene Symbol: HMBS
  Gene Name: hydroxymethylbilane synthase
  Uniprot ID: P08397
  ENST ID: ENST00000392841
  CDS Start-End: 111-1145
agtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgt

SEQ ID NO: 141688 - DNA, 1548 bp, Homo sapiens
  Payload ID: 7861
  Gene Symbol: HMBS
  Gene Name: hydroxymethylbilane synthase
  Uniprot ID: P08397
  ENST ID: ENST00000442944
  CDS Start-End: 264-1298
ccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcgtcattccagagccctggactaggagtaggaagatctgaattgtggccccaactctctttcggttattagctctgtgaccctaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaa

SEQ ID NO: 141689 - DNA, 1351 bp, Homo sapiens
  Payload ID: 7861
  Gene Symbol: HMBS
  Gene Name: hydroxymethylbilane synthase
  Uniprot ID: P08397
  ENST ID: ENST00000544387
  CDS Start-End: 121-1086
agactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 141690 - DNA, 507 bp, Homo sapiens
  Payload ID: 7861
  Gene Symbol: HMBS
  Gene Name: hydroxymethylbilane synthase
  ENST ID: ENST00000536813
  CDS Start-End: 150-507
gacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcagggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttc

SEQ ID NO: 141691 - DNA, 832 bp, Homo sapiens
  Payload ID: 7861
  Gene Symbol: HMBS
  Gene Name: hydroxymethylbilane synthase
  ENST ID: ENST00000535793
  CDS Start-End: 120-311
gactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcgcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaagttgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcaggtagggcctgcccc

SEQ ID NO: 141692 - DNA, 1155 bp, Homo sapiens
  Payload ID: 7861
  Gene Symbol: HMBS
  Gene Name: hydroxymethylbilane synthase
  ENST ID: ENST00000539986
  CDS Start-End: 595-1155
gaacaaacagatcctggtgggacagtgtacccaaggtcacccagccaagaggctgagcaggactgtacgtcagatccgtttacctcagtccttaatgcatgcagtccagccagattaagggacccttaatactgtcagctttccccactgtgggatcttcatcctcttgacttcttttgtagccagacatctgggcctcttgctggagaaggtggcagcttgctgctcttagactctagtctactccatgtggcatctggatggcactgaaattttctcaagtgccttgtctgttgtagataatgaatctatcctccagtgactcagcacaggttccccagtgtggtcctggctgccctgcccctgccagctgcaggccccacccttcctgtggccaggctgatgggccttatctctttacccacctggctgtgcacagcactcccactgacaactgccttggtcaaggtgggcttcagggctcagtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcag

SEQ ID NO: 141693 - DNA, 755 bp, Homo sapiens
  Payload ID: 7861
  Gene Symbol: HMBS
  Gene Name: hydroxymethylbilane synthase
  ENST ID: ENST00000535253
  CDS Start-End: 195-755
gctcagtgtcctggttactgcagcggcagcaacagcaggtcctactatcgcctccctctagtctctgcttctctggatccctgaggagggcagaagccagtgattctggttcttggacaaggtgttgaggaacactagaaacagaggggactgtgacctggggactttttctgcaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcag

SEQ ID NO: 141694 - DNA, 1469 bp, Homo sapiens
  Payload ID: 7861
  Gene Symbol: HMBS
  Gene Name: hydroxymethylbilane synthase
  Uniprot ID: P08397
  ENST ID: ENST00000542729
  CDS Start-End: 292-1206
gacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaagg

SEQ ID NO: 141695 - DNA, 1559 bp, Homo sapiens
  Payload ID: 7861
  Gene Symbol: HMBS
  Gene Name: hydroxymethylbilane synthase
  Uniprot ID: P08397
  ENST ID: ENST00000537841
  CDS Start-End: 292-1326
gacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaa

SEQ ID NO: 141696 - DNA, 936 bp, Homo sapiens
  Payload ID: 7861
  Gene Symbol: HMBS
  Gene Name: hydroxymethylbilane synthase
  ENST ID: ENST00000542822
  CDS Start-End: 128-373
aggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcaggtagggcctgcccct

SEQ ID NO: 141697 - DNA, 1282 bp, Homo sapiens
  Payload ID: 7861
  Gene Symbol: HMBS
  Gene Name: hydroxymethylbilane synthase
  ENST ID: ENST00000545621
  CDS Start-End: 154-399
aagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcagtgagttttctggaaaggagtggaagctaatgggaagcccagtaccccgagaggagagaacacaacatttctggctttgcctatagctaaagcccgtcccgctgccccgagattccttctgggctgctcccagttctgaagttgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtcccatgctttgcgccattggttggggaaagatcaggcctgatgtcctaggatgtttttccatcagggggccttgggcgtggaagtgcgagccaaggaccaggacatcttggatctggtgggtgtgctgcacgatcccgagactctgcttcgctgcatcgctg

SEQ ID NO: 141698 - DNA, 1347 bp, Homo sapiens
  Payload ID: 7861
  Gene Symbol: HMBS
  Gene Name: hydroxymethylbilane synthase
  ENST ID: ENST00000543090
  CDS Start-End: 105-1097
tcgggtcccacgtgtccccggtactcgccggccggagcccccggcttcccggggccgggggaccttagcggcacccacacacagcctactttccaagcggagccatgtctggtaacggcaatgcggctgcaacggcgcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaa

SEQ ID NO: 141699 - DNA, 708 bp, Homo sapiens
  Payload ID: 7861
  Gene Symbol: HMBS
  Gene Name: hydroxymethylbilane synthase
  ENST ID: ENST00000546302
  CDS Start-End: 135-708
ggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagg

SEQ ID NO: 141700 - DNA, 1171 bp, Homo sapiens
  Payload ID: 7862
  Gene Symbol: HPGD
  Gene Name: hydroxyprostaglandin dehydrogenase 15-(NAD)
  Uniprot ID: P15428
  ENST ID: ENST00000296521
  CDS Start-End: 37-573
agctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttcca

SEQ ID NO: 141701 - DNA, 3027 bp, Homo sapiens
  Payload ID: 7862
  Gene Symbol: HPGD
  Gene Name: hydroxyprostaglandin dehydrogenase 15-(NAD)
  Uniprot ID: P15428
  ENST ID: ENST00000296522
  CDS Start-End: 448-1248
gctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcatctctggtgtatactgattgagaaaataattaaactgaagttaggggagggg

SEQ ID NO: 141702 - DNA, 805 bp, Homo sapiens
  Payload ID: 7862
  Gene Symbol: HPGD
  Gene Name: hydroxyprostaglandin dehydrogenase 15-(NAD)
  Uniprot ID: P15428
  ENST ID: ENST00000422112
  CDS Start-End: 38-634
gagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagtta

SEQ ID NO: 141703 - DNA, 1910 bp, Homo sapiens
  Payload ID: 7862
  Gene Symbol: HPGD
  Gene Name: hydroxyprostaglandin dehydrogenase 15-(NAD)
  ENST ID: ENST00000504433
  CDS Start-End: 49-579
gcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggtatctcttctgtatgcagacatttgaaaacctggctggcagaagttctgccgtcttcagcagggagctcccagggttactttagaactgctggattcctttttctctagcagaaagagaagaagaacatggaggaggcatggctactcttttaagaaccccagcccagtaatggcagaccttctgctcacatttcagtatagaacttgagctcatgtttcacctaactgtaagcgagtctgtctgggaaatgcagtctagctgtgtgcctaagagaagaatggatttcagagggcagctaatcatcttttccacagcatgcaatcctaaactatagtattttcagagtagtatgatttagtatcagctgatatcttatccttcaatactagccttaaacctctgactggactttttggagcaactgagtcaagtgactttactttttaaaactctaggaaaaaatcatcaatgattcttgaatagttcaagtgaaattgtgaagtttaagaagtctgatcaacatggacagcaaatctaagctatcttgtccaaaaaagtgagactttaaaaaattatctgtttggttttagttaatgtggtgatttcagaatagaaatttcagccccacaccccaccccaaccttggcatctcagctccagtgatttgggaagttgggtttggaggtacctgtgattgaacctctgtctgattctcagcatttgtctcatccctctaggaatgattatcaaatggttcttttatatcactgtaaagctgccaccagaggagatttagaaatctcctttagaagttctcaaaaatagactagcatctcattttctgggtcgcttaaagtcaaaatcatgtccctaaagctattacaaacctatttctataaatttttcagggtaatcagattctttttcctagtggtacaactacttataaattataacattttaatcctaatgatactttaaaaggtgagcgcacgggcaatatttgaaaggggtatgtgttccagagagggccaaatgttaagctgtgggagactgaaaccctaaaagcaaattggcaaagctaaatctatactattttgaaataaaatcataagaaaaaaacaagtgactggagaattaaaaagagatatttagtattttcttaaaagtttaaatatttaaaaacctggggctgtgatcaagattgataattctctgtattctttcataaagctaagagggtcagcaaagcttggagtaccatgaatattctacaaggagcccctggcctttatgtcactggaggcactgatttcattctttggaaggctgaaagcctcagagttggatcaatttaggacgatctgggagaaattctttaccataagagggtgcttccttgccccaaagagcatgaataaagaaatgcaatgtagaa

SEQ ID NO: 141704 - DNA, 1535 bp, Homo sapiens
  Payload ID: 7862
  Gene Symbol: HPGD
  Gene Name: hydroxyprostaglandin dehydrogenase 15-(NAD)
  Uniprot ID: P15428
  ENST ID: ENST00000510901
  CDS Start-End: 713-1150
gacagagcagagtccacttctcatctccagtatccgtaaaaatttgtccaaaatgtaactaagaaaacacaatgatattagttacttctgctccccgtcaccctcaaccccactgattacgagatgggaactcacacaaaactttgagacaaaagagcaacaagtttgctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacac

SEQ ID NO: 141705 - DNA, 819 bp, Homo sapiens
  Payload ID: 7862
  Gene Symbol: HPGD
  Gene Name: hydroxyprostaglandin dehydrogenase 15-(NAD)
  ENST ID: ENST00000506910
  CDS Start-End: 522-819
aatatgacacacaattgacactgaccagaaacacagcgccaaggacactctagtcctagccatgaaatgttatgattccaggttttcaggacagagcagagtccacttctcatctccagtatccgtaaaaatttgtccaaaatctgcctgccaatcacggagccagaggctgaggggaggctttgagccggtctgcgagtccggaaggcaaagatcgcgaagcttggcgctccagaacgctcagggggcaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttgg

SEQ ID NO: 141706 - DNA, 827 bp, Homo sapiens
  Payload ID: 7862
  Gene Symbol: HPGD
  Gene Name: hydroxyprostaglandin dehydrogenase 15-(NAD)
  ENST ID: ENST00000514584
  CDS Start-End: 537-827
atttctctgcccacacactccgagactcgccccgccgcccgaggtgcactggcggagacagggaggccgcgcccggcgtgcccactttgccacttccaaaatttgctgaagctgaggctgtgagcacacctcagaagtggctgggagggaacccaaacctaattgccaaatttcaggtccaggaggggagcctcttgtgtgtttattgtttgtccgtctatttcgtgagctgcgcaggcccgcgattcctctcctcttgtctataggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatgga

SEQ ID NO: 141707 - DNA, 1046 bp, Homo sapiens
  Payload ID: 7862
  Gene Symbol: HPGD
  Gene Name: hydroxyprostaglandin dehydrogenase 15-(NAD)
  ENST ID: ENST00000508330
  CDS Start-End: 191-454
agaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagaggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggat

SEQ ID NO: 141708 - DNA, 1553 bp, Homo sapiens
  Payload ID: 7862
  Gene Symbol: HPGD
  Gene Name: hydroxyprostaglandin dehydrogenase 15-(NAD)
  ENST ID: ENST00000510835
  CDS Start-End: 25-138
gcccgccccagcagtggctgcaccatgcacgtgaacggcaaagtggcgctggtgaccggcgcggctcagggcataggcagagcctttgcagaggcgctgctgcttaagggcgccaagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctaccc

SEQ ID NO: 141709 - DNA, 2920 bp, Homo sapiens
  Payload ID: 7862
  Gene Symbol: HPGD
  Gene Name: hydroxyprostaglandin dehydrogenase 15-(NAD)
  Uniprot ID: P15428
  ENST ID: ENST00000541923
  CDS Start-End: 704-1141
gctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagaggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcatctctggtgtatactgattgagaaaataattaaactgaagttaggggagggg

SEQ ID NO: 141710 - DNA, 2786 bp, Homo sapiens
  Payload ID: 7862
  Gene Symbol: HPGD
  Gene Name: hydroxyprostaglandin dehydrogenase 15-(NAD)
  Uniprot ID: P15428
  ENST ID: ENST00000542498
  CDS Start-End: 448-879
gctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcagcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcatctctggtgtatactgattgagaaaataattaaactgaagttaggggagggg

SEQ ID NO: 141711 - DNA, 1265 bp, Homo sapiens
  Payload ID: 7863
  Gene Symbol: HYI
  Gene Name: hydroxypyruvate isomerase (putative)
  Uniprot ID: Q5T013
  ENST ID: ENST00000372425
  CDS Start-End: 197-1030
gtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattgtcatatgtctctgtaatggggtggtgggacacatagtgtctaacacttcagtttctctgctgcttccctcccattgagaagccagtgccagggttgctgtgaagatgggagagcttctgaacccacctcattaaaggatgagaaacccag

SEQ ID NO: 141712 - DNA, 796 bp, Homo sapiens
  Payload ID: 7863
  Gene Symbol: HYI
  Gene Name: hydroxypyruvate isomerase (putative)
  ENST ID: ENST00000372430
  CDS Start-End: 1-716
cgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaa

SEQ ID NO: 141713 - DNA, 1066 bp, Homo sapiens
  Payload ID: 7863
  Gene Symbol: HYI
  Gene Name: hydroxypyruvate isomerase (putative)
  Uniprot ID: Q5T013
  ENST ID: ENST00000372432
  CDS Start-End: 171-914
cgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaa

SEQ ID NO: 141714 - DNA, 796 bp, Homo sapiens
  Payload ID: 7863
  Gene Symbol: HYI
  Gene Name: hydroxypyruvate isomerase (putative)
  ENST ID: ENST00000372433
  CDS Start-End: 1-640
cgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacatt

SEQ ID NO: 141715 - DNA, 1025 bp, Homo sapiens
  Payload ID: 7863
  Gene Symbol: HYI
  Gene Name: hydroxypyruvate isomerase (putative)
  ENST ID: ENST00000372434
  CDS Start-End: 33-941
cgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctggacatgatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacatt

SEQ ID NO: 141716 - DNA, 905 bp, Homo sapiens
  Payload ID: 7863
  Gene Symbol: HYI
  Gene Name: hydroxypyruvate isomerase (putative)
  ENST ID: ENST00000486909
  CDS Start-End: 56-886
cgccgcccgccgcctttggatcccgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggtgaggcgtggccctggggaagggagctctggagggacccggacaggggctgttttctccttgtgggctgaggtgccgaggcctccctct

SEQ ID NO: 141717 - DNA, 637 bp, Homo sapiens
  Payload ID: 7863
  Gene Symbol: HYI
  Gene Name: hydroxypyruvate isomerase (putative)
  ENST ID: ENST00000487366
  CDS Start-End: 1-485
gggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaa

SEQ ID NO: 141718 - DNA, 640 bp, Homo sapiens
  Payload ID: 7863
  Gene Symbol: HYI
  Gene Name: hydroxypyruvate isomerase (putative)
  ENST ID: ENST00000470662
  CDS Start-End: 1-560
gacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaa

SEQ ID NO: 141719 - DNA, 1322 bp, Homo sapiens
  Payload ID: 7863
  Gene Symbol: HYI
  Gene Name: hydroxypyruvate isomerase (putative)
  ENST ID: ENST00000583037
  CDS Start-End: 197-1015
gtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctggacatgatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattgtcatatgtctctgtaatggggtggtgggacacatagtgtctaacacttcagtttctctgctgcttccctcccattgagaagccagtgccagggttgctgtgaagatgggagagcttctgaacccacctcattaaaggatgagaaacccag

SEQ ID NO: 141720 - DNA, 901 bp, Homo sapiens
  Payload ID: 7864
  Gene Symbol: HSD11B1
  Gene Name: hydroxysteroid (11-beta) dehydrogenase 1
  ENST ID: ENST00000261465
  CDS Start-End: 66-901
ttgttcgaaatcttgaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttct

SEQ ID NO: 141721 - DNA, 1405 bp, Homo sapiens
  Payload ID: 7864
  Gene Symbol: HSD11B1
  Gene Name: hydroxysteroid (11-beta) dehydrogenase 1
  Uniprot ID: P28845
  ENST ID: ENST00000367027
  CDS Start-End: 98-976
acaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttctta

SEQ ID NO: 141722 - DNA, 1461 bp, Homo sapiens
  Payload ID: 7864
  Gene Symbol: HSD11B1
  Gene Name: hydroxysteroid (11-beta) dehydrogenase 1
  Uniprot ID: P28845
  ENST ID: ENST00000367028
  CDS Start-End: 155-1033
gagatgaaacagaaggaaaggcagaggaggagggagagagagagaagagaagaaaaagaaaaaagaacatcaataaaaagaagtcagatttgttcgaaatcttgaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttctt

SEQ ID NO: 141723 - DNA, 681 bp, Homo sapiens
  Payload ID: 7864
  Gene Symbol: HSD11B1
  Gene Name: hydroxysteroid (11-beta) dehydrogenase 1
  ENST ID: ENST00000615289
  CDS Start-End: 135-681
gagagatgaaacagaaggaaaggcagaggaggagggagagagagagaagagaagaaaaagaaaaaagaacatcaataaaaagaagtcagatttgttcgaaatcttgaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcct

SEQ ID NO: 141724 - DNA, 1457 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000301382
  CDS Start-End: 263-880
cctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141725 - DNA, 1660 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000339423
  CDS Start-End: 223-1083
cgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141726 - DNA, 1620 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000342970
  CDS Start-End: 444-1043
accaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141727 - DNA, 1362 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000411793
  CDS Start-End: 490-1035
cctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141728 - DNA, 1525 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000423665
  CDS Start-End: 251-1198
cgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141729 - DNA, 730 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000422535
  CDS Start-End: 239-502
gggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcacggtggctcacgcttgtagtcagcactttgggaggccgaggaaagtggatcacctgaggtcaggagttcaagaccagcctggccaacatggcgaaacctggtctctactaagaagacaaaaattaggccaggcatggtggctcatgcctgtaatcctagcactttgggaggccaaggcggatggatcacttgaggtcaggagttcaaaaccagcctggccaacatggtgaaaccctgtctctactaaaaatacaaaaaataaaaataaaataaataaataaaaaa

SEQ ID NO: 141730 - DNA, 709 bp, Homo sapiens
  Payload ID: 7865
  Gene Symbol: HSD11B1L
  Gene Name: hydroxysteroid (11-beta) dehydrogenase 1-like
  ENST ID: ENST00000584904
  CDS Start-End: 250-348
gaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctg

SEQ ID NO: 141731 - DNA, 1575 bp, Homo sapiens
  Payload ID: 7865
  Gene Symbol: HSD11B1L
  Gene Name: hydroxysteroid (11-beta) dehydrogenase 1-like
  ENST ID: ENST00000579562
  CDS Start-End: 250-477
gaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141732 - DNA, 1319 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000583928
  CDS Start-End: 322-780
gaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggaccca

SEQ ID NO: 141733 - DNA, 861 bp, Homo sapiens
  Payload ID: 7865
  Gene Symbol: HSD11B1L
  Gene Name: hydroxysteroid (11-beta) dehydrogenase 1-like
  ENST ID: ENST00000578046
  CDS Start-End: 1-407
ggctgggggccctgttcttcgcctattattgggatgacaacttcgacccaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggtgaggcccggacaagctgggggctgggctgggggccatggcccagccccagccgcagtccccaccgtgccctcctgtccccaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggag

SEQ ID NO: 141734 - DNA, 1687 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000581773
  CDS Start-End: 400-1260
ctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggctggagtgcaatggcaaatctcggcacactacaacttctgcctcccaggttcaagcgattctcctgcctcagcctcccaaatatctggattacaggcatgcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctag

SEQ ID NO: 141735 - DNA, 1553 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000577917
  CDS Start-End: 522-1226
gtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141736 - DNA, 695 bp, Homo sapiens
  Payload ID: 7865
  Gene Symbol: HSD11B1L
  Gene Name: hydroxysteroid (11-beta) dehydrogenase 1-like
  ENST ID: ENST00000579559
  CDS Start-End: 128-695
tcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcct

SEQ ID NO: 141737 - DNA, 735 bp, Homo sapiens
  Payload ID: 7865
  Gene Symbol: HSD11B1L
  Gene Name: hydroxysteroid (11-beta) dehydrogenase 1-like
  ENST ID: ENST00000582346
  CDS Start-End: 270-413
ccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcag

SEQ ID NO: 141738 - DNA, 1884 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000581521
  CDS Start-End: 476-1336
cggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggctggagtgcaatggcaaatctcggcacactacaacttctgcctcccaggttcaagcgattctcctgcctcagcctcccaaatatctggattacaggcatagatggggtttcaccatgttggccaggctggtctcgaactcctgatctcaagtgatttgcccgcctcagcctcccaaagtgctgggattccaggcatgagccaccacatccagctgaaggaggtcacttttgcactgagacttgaaagaagcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgt

SEQ ID NO: 141739 - DNA, 1540 bp, Homo sapiens
  Payload ID: 7865
  Gene Symbol: HSD11B1L
  Gene Name: hydroxysteroid (11-beta) dehydrogenase 1-like
  Uniprot ID: Q7Z5J1
  ENST ID: ENST00000581893
  CDS Start-End: 505-963
gggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 141740 - DNA, 502 bp, Homo sapiens
  Payload ID: 7865
  Gene Symbol: HSD11B1L
  Gene Name: hydroxysteroid (11-beta) dehydrogenase 1-like
  ENST ID: ENST00000578832
  CDS Start-End: 180-407
gggagggggtgcggtcggggacccggcaggaggcggccgagaagagaggaccgtgggggcgttcgcgtggctcccagcccgggaccccacccccgctggacagtgggggaaactgaggcctgagcgggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactg

SEQ ID NO: 141741 - DNA, 1151 bp, Homo sapiens
  Payload ID: 7865
  Gene Symbol: HSD11B1L
  Gene Name: hydroxysteroid (11-beta) dehydrogenase 1-like
  ENST ID: ENST00000577257
  CDS Start-End: 721-1151
gtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgca

SEQ ID NO: 141742 - DNA, 1580 bp, Homo sapiens
  Payload ID: 7865
  Gene Symbol: HSD11B1L
  Gene Name: hydroxysteroid (11-beta) dehydrogenase 1-like
  ENST ID: ENST00000616276
  CDS Start-End: 1-1002
atggcaaatctcggcacactacaacttctgcctcccaggttcaagcgattctcctgcctcagcctcccaaatatctggattacaggcatgcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgcat

SEQ ID NO: 141743 - DNA, 1900 bp, Homo sapiens
  Payload ID: 7866
  Gene Symbol: HSD11B2
  Gene Name: hydroxysteroid (11-beta) dehydrogenase 2
  Uniprot ID: P80365
  ENST ID: ENST00000326152
  CDS Start-End: 133-1350
cagagaaagcgagtgtccctctcgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttctaaaa

SEQ ID NO: 141744 - DNA, 634 bp, Homo sapiens
  Payload ID: 7866
  Gene Symbol: HSD11B2
  Gene Name: hydroxysteroid (11-beta) dehydrogenase 2
  ENST ID: ENST00000566606
  CDS Start-End: 1-177
ctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggggcctggatcccatccagaccctggtgattctggggttgtctcaggctaggctgggccacagtggaagttcactgactgccctggcctggccaggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggag

SEQ ID NO: 141745 - DNA, 1265 bp, Homo sapiens
  Payload ID: 7867
  Gene Symbol: HSD17B1
  Gene Name: hydroxysteroid (17-beta) dehydrogenase 1
  ENST ID: ENST00000225929
  CDS Start-End: 1-990
atggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggggctgcctttcaatgacgtttattgcgccagcaagttcgcgctcgaaggcttatgcgagagtctggcggttctgctgctgccctttggggtccacagcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatggctgtcgcctgtaatgccagcgctttgggaggcggaggcaggaggatcgctcaagccccggagttggagaccagccagagcaacacagtgagacccccatctctacaaaaataaagaaaatttaaaaatc

SEQ ID NO: 141746 - DNA, 1059 bp, Homo sapiens
  Payload ID: 7867
  Gene Symbol: HSD17B1
  Gene Name: hydroxysteroid (17-beta) dehydrogenase 1
  ENST ID: ENST00000590299
  CDS Start-End: 12-461
acagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggcttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatggctgtcgcct

SEQ ID NO: 141747 - DNA, 4982 bp, Homo sapiens
  Payload ID: 7867
  Gene Symbol: HSD17B1
  Gene Name: hydroxysteroid (17-beta) dehydrogenase 1
  Uniprot ID: P14061
  ENST ID: ENST00000585807
  CDS Start-End: 3721-4707
agttaggtgggacttgggttggggtagagtcaggttgtgacctgcactccattagccatgagacctcaggcaagttccttgctttctctgagtgctttcctttcctttcccttttcttttcttttttgtttttcttttgttttgagacggagtttcactcttgttgcccagcctggagtgcaatagcgcggtctcagttcaccacaacctctgcctcccgggttcaagtgtagctaggattgcaggcatgtgccaccacgcccagctaattttgtatttttagtagagacgaggtttctccatgttggtcagactggtcttggactcccgacctcaggtgatccgcccgccctggcctctcagagtgctgggattacaggcatgacccaccccatccggccctctgagtctttcttatctgtaaaatgggtataataatacctatctaatcggttttagtaatggtggagataatgcctgaaagtgctagtatagaggtttaatacccagcaaggactgttattagaatgaatagtaatatgactactgtcacattttgcaaatgtgtaaagaagaaagagggctaagtgaatcaaagggagacagccccactcaccctgttctgccccagaggactgagcgatccccaccatctgggaagctgcctcaccaggaggtccagctggggctacaggactggctactttgctacaatggcccatctttcctgagcccagtggagggtcccaggggggcagaagtcattgataggggccagtagggttgtagagccactgtctgaacttctgtggaggtctggtgcaggggaggtgtgaacagataggaggctaggtgaggatgcagcagaggaagggggcaggagtgccccaggagggggcggtaccgaggcagggattcagctgggtctgagagggagggaaggctgagggggatggccctttggagtgggcagggacatgaccacagaaagcctgggaagtggaaacagacaggagcctgctggagctcttggagctttgtgtggggcactaggggaaggaggcaggcactccaccctgacctgcccctacctctggatgagggtcttctctgcctgttggatgatgtgctgcccctgctcttggaggaagaggcctcccagccaccccctcctgccagtcgccttgccctgctgacccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccaccaaagaaaccccactgtctcccacagactccaggtctgtatctccaactgcctactcaatacaacacgtccacctgatacaatgaacttaatgtgtctaaaccccaattccacatttccagtcctcctaccggctcctcccccagtcttctctactttactatatgacaactccatttttcccaatactggttttaaaaaccctggagtagtccttgactccagtctctctcacctttcaaccaattcagcagcaaatactgacagctctacctttgctcatcaaagcatatccccaaatcaccctattccagactgcacactgtcatctctcccttcaattacagcagtagcctcctaactagttttcttgattccactcctgcccatcagcagtgaaattaccccagagcagttaaaatgatcttttaggatgggcacagtggctcacgcctgtaataccagcactttgggaggtggaggctggctgatccccttaggttgggagttcaagaccatcctcaccaacagggagaaaccccatctctactaaaaatacaaaaattagccggatgtggtgggacgtgtctgtaatcccaactacttgggaggctgagacaggagaactgcttgaacccgggaggtggaggttgcagtgagccagaatcgtgccacagcactccagcctgggcaagaagcgcgaaactccgtctcaaaataaaataatcttctaaaaatgacagggccaggtggggtggcacttttttataatccgagcactttgggaggctgaggtgggcagatcgcttgacatcaggggtttgagaccagcctggccaacatggtgaaactccgtctctactaaaaatactaaaaattagctgggcgtggtggcgggtgcctgtaatcccagctactcgggaggctgatgcaggagaatcgcctgaaccaggcagatgcaggatgcagtgagccaagattaagacactgcactccaacctaagcaatactttgtctcaaaaataaaaaaaagcctgggaaacaaagtgagaccccgtctctacaaaaaagtcaaaaaattagctgggtatggtggcagtgatggcacacacctgtagtcccggctacttgggaagctttttaatattttttgcagagaccgggtctcactctgttacctggcctggtcttgaactcctgggctccaacaatcccctttcctgggcctcccaaagtgctgggattacaggcatgagccaccgtgcccagcctcaaagcatattttaaaggatagaaataaacagccatatgaagagatacagacagggcggtctggaagggtccagagcaggagcttctatctccatagagttggggttacgtcaccctctgggcacattctgtcagcctccacacgttcagccctcagaagctcccgaaccctgtcctttgggccttttatggagaactccattggctgtccatgactgaagcatggacaactgtgataatgtgattgggcaaaaagggtctgatctaagcccagcaaggccagtccagattctttgggcctttgtgcagcattcctttctccagggtatggggcaaggacccactctggaatgaggatcctacaacccacaatcagattagagtcctgccttgggcagctgaaaagaggacaggagaaggtcagagagacgaaaggctgttttttgaggcctgaggcaccccaacatgacaacgtaagactgtaaccatggtcatgtgagttatgagctaggaaccctggacgaaaccagcacatatacaatcatctcccacctcccaacgcctttactttcacagcctctgcagcaaactgcggtcactataatcgctcctgtggcacagaggcatacccaggggaatctgcccagggggccactctgtgcccacgtgggaacccacacctgcttgtaaagcctcccctccctctgaccagcaaccaggacagtttgttgttccaagcagtgggctcatgtctgttttggctcagaacagggtggggagagcgggccagggacccgcaggaaggcttatccttgagattgcgtgggagacacaacaaggggtgggggcccgcaggcggggcggggcgaagcaggtgatatcaagcccagagccccagcctctccccacagtctcaccatggcccgcaccgtggtgctcatcaccggctgttcctcgggcatcggcctgcacttggccgtacgtctggcttcagatccatcccagagcttcaaagtgtatgccacgttgagggacctgaaaacacagggccggctgtgggaggcggcccgggccctggcatgccctccgggatccctggagacgttgcagctggacgtaagggactcaaaatccgtggccgctgcccgggaacgcgtgactgagggccgcgtggacgtgctggtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatggggctgcctttcaatgacgtttattgcgccagcaagttcgcgctcgaaggcttatgcgagagtctggcggttctgctgctgccctttggggtccacttgagcctgatcgagtgcggcccagtgcacaccgccttcatggagaaggtgttgggcagcccagaggaggtgctggaccgcacggacatccacaccttccaccgcttctaccaatacctcgcccacagcaagcaagtctttcgcgaggcggcgcagaaccctgaggaggtggcggaggtcttcctcaccgctttgcgcgccccgaagccgaccctgcgctacttcaccaccgagcgcttcctgcccctgctgcggatgcgcctggacgaccccagcggctccaactacgtcaccgccatgcaccgggaagtgttcggcgacgttccggcaaaggccgaggctggggccgaggctgggggcggggccgggcctggggcagaggacgaggccgggcgcggtgcggtgggggaccctgagctcggcgatcctccggccgccccgcagtaaaggcttcctcagccgctgtctcccgcgcccttctttgtcccctgggtctgtgtggtccctggggatggggcggcggtagcagctgtgggtggctaattaagatagatcgcgttagccagttttaccagcgcagctaggcgcgatggctgtcgcctgtaatgccagcgctttgggaggcggaggcaggaggatcgctcaagccccggagttggagaccagccagagcaacacagtgagacccccatctctacaaaaataaagaaaatttaaaaatc

SEQ ID NO: 141748 - DNA, 960 bp, Homo sapiens
  Payload ID: 7868
  Gene Symbol: HSD17B10
  Gene Name: hydroxysteroid (17-beta) dehydrogenase 10
  Uniprot ID: Q99714
  ENST ID: ENST00000168216
  CDS Start-End: 29-814
cccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagag

SEQ ID NO: 141749 - DNA, 823 bp, Homo sapiens
  Payload ID: 7868
  Gene Symbol: HSD17B10
  Gene Name: hydroxysteroid (17-beta) dehydrogenase 10
  ENST ID: ENST00000375298
  CDS Start-End: 6-515
acaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctca

SEQ ID NO: 141750 - DNA, 916 bp, Homo sapiens
  Payload ID: 7868
  Gene Symbol: HSD17B10
  Gene Name: hydroxysteroid (17-beta) dehydrogenase 10
  Uniprot ID: Q99714
  ENST ID: ENST00000375304
  CDS Start-End: 12-770
ccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagag

SEQ ID NO: 141751 - DNA, 1885 bp, Homo sapiens
  Payload ID: 7869
  Gene Symbol: HSD17B11
  Gene Name: hydroxysteroid (17-beta) dehydrogenase 11
  Uniprot ID: Q8NBQ5
  ENST ID: ENST00000358290
  CDS Start-End: 317-1219
tggtgtaaaagacaatcgcggccacacaccgcgtgggggctgcgcaaagcagaactaggaagctttgctccggtctggacttcgtccctcccagatctctgagctagcaagcactgcagcccgagccaattgcgaaagaccaacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaa

SEQ ID NO: 141752 - DNA, 851 bp, Homo sapiens
  Payload ID: 7869
  Gene Symbol: HSD17B11
  Gene Name: hydroxysteroid (17-beta) dehydrogenase 11
  ENST ID: ENST00000507286
  CDS Start-End: 80-850
gatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataag

SEQ ID NO: 141753 - DNA, 2420 bp, Homo sapiens
  Payload ID: 7870
  Gene Symbol: HSD17B12
  Gene Name: hydroxysteroid (17-beta) dehydrogenase 12
  Uniprot ID: Q53GQ0
  ENST ID: ENST00000278353
  CDS Start-End: 120-1058
aaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatg

SEQ ID NO: 141754 - DNA, 994 bp, Homo sapiens
  Payload ID: 7870
  Gene Symbol: HSD17B12
  Gene Name: hydroxysteroid (17-beta) dehydrogenase 12
  Uniprot ID: Q53GQ0
  ENST ID: ENST00000395700
  CDS Start-End: 48-344
cactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataagcaattatacttgagacctgaattacaatatggcaaagactcttaactaacttctactcaatcaaccagatggataaaccaatgctgttcatttgtttggtaaaacatactaactgatgtccccagtttgctgaccatttgtggccaggaagcttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtattta

SEQ ID NO: 141755 - DNA, 611 bp, Homo sapiens
  Payload ID: 7870
  Gene Symbol: HSD17B12
  Gene Name: hydroxysteroid (17-beta) dehydrogenase 12
  ENST ID: ENST00000531185
  CDS Start-End: 120-611
aaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaacc

SEQ ID NO: 141756 - DNA, 2269 bp, Homo sapiens
  Payload ID: 7871
  Gene Symbol: HSD17B13
  Gene Name: hydroxysteroid (17-beta) dehydrogenase 13
  Uniprot ID: Q7Z5P4
  ENST ID: ENST00000302219
  CDS Start-End: 46-840
gactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 141757 - DNA, 2397 bp, Homo sapiens
  Payload ID: 7871
  Gene Symbol: HSD17B13
  Gene Name: hydroxysteroid (17-beta) dehydrogenase 13
  Uniprot ID: Q7Z5P4
  ENST ID: ENST00000328546
  CDS Start-End: 66-968
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 141758 - DNA, 1238 bp, Homo sapiens
  Payload ID: 7872
  Gene Symbol: HSD17B14
  Gene Name: hydroxysteroid (17-beta) dehydrogenase 14
  Uniprot ID: Q9BPX1
  ENST ID: ENST00000263278
  CDS Start-End: 268-1080
gggaggagggactgaggcttctggattcctgggtctgtgggaggagggactggggctcctggattcctgggtctgtgggaagagaggagtgtctgagggaggaggggctggggacaaacttccaggtctctagccttcctggcaacgccccccgaggccggacttccaggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcagccagaag

SEQ ID NO: 141759 - DNA, 674 bp, Homo sapiens
  Payload ID: 7872
  Gene Symbol: HSD17B14
  Gene Name: hydroxysteroid (17-beta) dehydrogenase 14
  ENST ID: ENST00000595764
  CDS Start-End: 1-531
gttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaagctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatca

SEQ ID NO: 141760 - DNA, 555 bp, Homo sapiens
  Payload ID: 7872
  Gene Symbol: HSD17B14
  Gene Name: hydroxysteroid (17-beta) dehydrogenase 14
  ENST ID: ENST00000596349
  CDS Start-End: 1-321
ggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccaggtagaagtggggttcagatccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcagccagaa

SEQ ID NO: 141761 - DNA, 991 bp, Homo sapiens
  Payload ID: 7872
  Gene Symbol: HSD17B14
  Gene Name: hydroxysteroid (17-beta) dehydrogenase 14
  ENST ID: ENST00000599157
  CDS Start-End: 100-840
ggatccagcctctattgaggatttgatgcgacggcctcacggggctttggaggtgaaagaggcccagagtagagagagagagagaccgacgtacacgggatggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaaggacatttcctttctcctcagaccctggtttctgagaccatccgccgatttggccgcctggattgtgttgtcaacaacgctggccaccctcgccctcccctacctgcggaagagtcaagggaatgtcatcaacatctccagcctggtgggggcaatcggccaggcccaggcagttccctatgtggccaccaagggggcagtaacagccatgaccaaagctttggccctggatgaaagtccatatggtgtccgagtcaactgtatctccccaggaaacatctggaccccgctgtgggaggagctggcagccttaatgccagaccctagggccacaatccgagagggcatgctggcccagccactgggccgcatgggccagcccgctgaggtcggggctgcggcagtgttcctggcctccgaagccaacttctgcacgggcattgaactgctcgtgacggggggtgcagagctggggtacgggtgcaaggccagtcggagcacccccgtggacgcccccgatatcccttcctgatttctctcatttctacttggggcccccttcctaggactctcccaccccaaactccaacctgtatcagatgcagcccccaagcccttagactctaagcccagttagcaaggtgccgggtcaccctgcaggttcccataaaaacgatttgcag

SEQ ID NO: 141762 - DNA, 1455 bp, Homo sapiens
  Payload ID: 7873
  Gene Symbol: HSD17B2
  Gene Name: hydroxysteroid (17-beta) dehydrogenase 2
  Uniprot ID: P37059
  ENST ID: ENST00000199936
  CDS Start-End: 194-1357
aagtgcacactggtttaaattacccactgggaatatgattatgcttaatctatgctcagttgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 141763 - DNA, 1302 bp, Homo sapiens
  Payload ID: 7873
  Gene Symbol: HSD17B2
  Gene Name: hydroxysteroid (17-beta) dehydrogenase 2
  ENST ID: ENST00000569351
  CDS Start-End: 1-603
tctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggtgagtcagcattttcacacatggtcatggggtgcccatcacaagacatggctcatggcattctatgtgggcgaacaaaaatgcagggcatgcaaaggcagggttgggtcaggattagtcaaattgtatataccctgttggtcttatcacaataaaacctttctcttctttcaaattctttcatgtagaaactcttatctgccttctaactcatccatttgttactggggatttagggttcttatatgtctttataatgtgactgccaacacacatggttggtagatttgtacaggaaatctcacattacaaataatgtcagcatttcaggcaacctgttttcaacacttcgtcaatttaacacactgtgttcagttccctgtaagctgagtaggcaataccttccctctgtttgtgccatcaaacaaaagctgcctgctattgttaacccgaagattgtccccagtgttgagcagcctcaatccagctaggtcaggatgtgatgacactggatagtttgtctctctctgtttccaagaacaaatagtacacaacttgagtcaagggctgaacagtcttgccttttcataaaaaatgcccatgcgtgtcatagcatgccctcttttctgggacagacattttcaaactggggttccttgggctcttgttcagtttagggaagatccatcgacctgacttttgggtcactgggtcactgcagaggtgagagggaagccaaagggatgggctctggatcctaggatcctgccttcaaatagaggagtaccactcttcactgttggatcaattaattctaagtaaaatttcttaaaataaagggtatgactatgctg

SEQ ID NO: 141764 - DNA, 487 bp, Homo sapiens
  Payload ID: 7873
  Gene Symbol: HSD17B2
  Gene Name: hydroxysteroid (17-beta) dehydrogenase 2
  ENST ID: ENST00000563491
  CDS Start-End: 289-487
cttgaagaagacagtattttcctgtgagctagaggatcttcctgttattctccatgcagttcaaattctgtcaattattatccagttagtcatcgctccagaggtggactgtcattaaaaaaaaatagaaggtgtgtgtttgtgggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgt

SEQ ID NO: 141765 - DNA, 7925 bp, Homo sapiens
  Payload ID: 7873
  Gene Symbol: HSD17B2
  Gene Name: hydroxysteroid (17-beta) dehydrogenase 2
  ENST ID: ENST00000566838
  CDS Start-End: 1-567
cgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaagtaggtttctgagcccaagaacctgtgatgttcatcctggaaggaaccccgaaggtcctcttggtctgacagagcacacattgaacccctcattgttgtcaaagatgagcacagccagagatcagttaaaggggtgaaaacaggtttgattcagtaactgctgacagtaggggaaagagctaagctccattctgatttgtgcgaaggtgttttaaacattttaaaaggaaaaccagggagaggggaaagcatggctcagtaagtcagattagtgaaaaagtacaagggtccatcagtgtccatgcagaggggccagctgtgtctgccagctggcaattaaagaagtccagattctgtcttcccacagagacagagaaacagaggtctgatccttgatgattcagttccaaaggaatggctctcagatcctggagagaaatgcttctgcattgcaagagctatatatttacaatttaaagttcttttttagtaagtatttcaggaaagggaagtcagggacctctcagggatgtcttggatagaacaaatagtaaaattttctggcaaggttgagccttcttaggcaggcattttagggaggggctggtgttatccaagggacagggccttatgctgctagaaactgtgctggagtttcgttaagtctcttagtgcagggggttgggaaggggttgtcatgcatccagagctctccagctctcagtgtccacccagcagggcttgggttgcatgggcctcttctaagtgccatgctctccatgtatggcttcacccctgcttcctttcacaaaggaattgcgttggcttataagtcatcagcaagcagaggccacactgggttagaaccctggtcccctggtgcctgctctgagcgggacctttctgggacacacactccctccctcaatggtagagttgtatttggtctgtgggaacgcagctcaaaaatggtccctaactgactctcaccaattttgattattttcattgccccacccaaacctgtttaacaatgtataatccattagtttcatactaggtttctttatttggcttcagagcttattttcatctaaaagtttgagcagatagtcagagtaacatttattagtcttttgctgccattggccaagaaggtttccttccccagcttctttatatttcagaaacaatatttttctccttccctctgaagaatatgacccacctcccctccaccccaagaggagaaggcccttctctccactcccctccctgcatatctgaactctgggaagaggcagcctaccccaaggctcagtcttcagttctgggccatcaaacatttaaccgatgattcaagtgaagatgtaaaaagtatgtctaataaaagaccacagactgggaggtattgctaaatgcacgaaagaacaaaccctaaaggtttgaatgttatcccaaatgcaaaagataaaatctatacagaaatattgaaattttggcttgaaacacttgatagctgagaacctcctaaggttgcagagggggtgcaagactcagagaaagggacagagacccagagaaagggatatgggtcaacacgatgacaggcaggaccagggcgatagaaatgcagagaagatgaagtcttgagatgggtttccaacttggggactccctgggttgggaggagaattgaggagaggagatggagaagagacatgggtcagaggtgaagccaaatgtgctggttggactgagagactgggatacaaagagagggaagctgcttgagagctggtacaagagggaaatggtgaatttgattttgaatctggcaggaggattgagtgtttggtgacacagcccaaagagaattccaacacacagatgtaaaattccatttagacgagagagcaatcctgcagttaggttatgattttggagattcagtataattgctatgcataatagttctggagagctgttctcacccacttaccatacattctttactgatgttgatcttaatttttaaaatcgagaaatatataaacagaaaaaagcattatacgcacagggttcaacaaattattataaatcctcttgtacttaacacccagatcaaaaaataaaacattaccaacacccagaagcccctatatgatcctctaccatcacagccctctccaacctcccaataggtaatcacctcttactttttgtaatgatcatttatttgcttttctttgtagagtcacatccagcccacttaatagcatttgactttaactgcttttgcactttcaatggaatcaatatgtatgtatccttttgtgtctggcttctttcactcaatattctgattagacaatttatctgcactgtgtgtagctgtagtccactcatttcattgctgtgcagtattctgtgaatatgccatgattttctactgttgatgggatgtttgagtcccttctagtttgaacaagtatgaacaatgcagctatgaactttctggtacatgtactttggtttttgtgtgcttgaattttcccatgacacatgctgcagagtgaaattgttaccaaaaagggctcctgatccagattccaagagagggtttttggatcttgtgtgagaaagaatttggggtgaatctgtagagtaaagtgaaagcaagtttattaagaaagtaaaggaataaaagaatgcctacttcttaggcagagcagcagcatggactgcttgactgagtatacttatagttacttcttgattatattctagacaaggagtggattattcatgagttttctgggaaagtgggagggatggcctggaactgtgggttcctcccccttttagaccatacagagcaacttctggacattgccatggcatttataaactgtcctggtgctggtggaagtgtcttttagcatgctaatgcattataagtagcatataatgagcagtgaggatgaccagaggtcactgttgttgccatcttgattttggtgggttttggctggctgctttaccacatcctgttttatcagcagagttactatgacttgtatcttgtgataccaatcctgccaacctcttatctaatcctgtgattaagaatgcttaacctccagggaatgcagcccagcaggtctcattctcattttacccagcccctattcaagatggagttactcttgttcaaatgcctctgaaagaatgactagatcatagagttttcctgtcttcagctttactgaatcataccaacctgttttctaaaatattgctccaatttatacctctaccctttctatgtatactccaatcaccacaactctgaggagcaggtttcattgacattattctccaggtgatggtgctgagttggggtggataacatgcccttgggtggggatctggtatcccacgtacaccgtgatggtggaaaatttgagatcagatcctgagatgcagtgcctgggttcttccttttatatcaggctgccccccagtttaaagctatttgatgagctctctcaaggcaagaagcccaagagcagaaggctgagaactcatgtttggagaatgacacttcatacttatatttatttgaaggtaggggcaagaaaaggaatcttcagggacacagacaaggagcttctgaagacattctaagagacattccagatttttctggtgccctgaaataaagatagctaaatcatactgcatgctagattagcagattttaagtgctttatgtgcattatctcccttaatcctcacctgtgaagtaggcatcataatagccccatcttgcagtgagaaaatggaggctcagagaagttaaggaagttccaaagccatagagctgataggaggcagagatgggattttgatacaggtcatatcaataacttcattgtgtgcagcaccaaagtggcatgggagggatgggtagggagagtctgtcaaaagtgggagatgatgacggactgatggcaaaaggctgatggctttgtcactcacagagacagctttggggactctggataggttacccacaagagtggccagaaattccatgaggtgtttaaagaagaatgaggtgtcagcccacgaagacagggacaggggagaggtaggaggaggaatagtagctcacgaaaacatgtttttcaggacctagaaacctccagagtaattgtcatgataatcatttctttaagcacggtgtgtgccttcctgaaaagaaaggagcaattgaaactccgtttgcatttccataagtataattggatttcactggcctacatttccaagtgagcatccctccttctctgcagtcctgatatccaggagtcaccgaagctagcaagggctcatccccacagctatgtgaacaaccaagcactttgcaggagacagcgtgggagaccgcaagctttttggaaagtaatctggcagtagctattaaaattcaaaattaatgtgccttcgaccaggctgtactttgaggactcttgcctacagaaataaagccaaagtaaaaacgaataggtggtgaaagtcgatttactgcagcagtgcctgaaatgctgaaacctataggaacaactggaaggtcattggatagggaagtgattggctaaaagctgttcaatgggaaattctgttgctctggtttaatccatagacattgacaagaagggaggtctgtgatttattactaagccaaaacaaattcatggaaaatataaacaccatagtatgatcctttttgtttttgttatttcctggtaaaaaaaattaaaccaaattcttctatgtgtatgtatgtttgtatgaacaaggaaggaatgtagaagggcacacaaaactgttagttaccttagaggagattaattttaaaaatatgcacatctccttattattcactttatataatgaggaggcagagctgctacattttaaagtaaataaattatttaattttatatgataagcaggtattgtctttattttaaaaatatatttatacttaattgcatgtagtttgtgtattaaaatttatgtgtgaattatattaaaattacacttcatatatttttaaaaacataaatgaaaattatatccattaagtagattaaatatttaaaatcctgtatttatttatttatttattgagatggagtctcactctctcacccaggctggagcgcagtggtgcgatctcagctcactgtaacctctgcctcctgggttcaagcaattctccctgcttcagcctcccaggtagctgggattccaggcacccaccaccatgcccagctaatttttgtattttttagtagacacagggtttcaccatgttggctaggctggtcttgaactcctgacctcaggtgatccacctacctgggcctcccaaagtgctgggattgcaggcatgagccaccatgcccagcctaaaatcctatatttaattggtaggcattacttctatatcttaaaaaattatacgtgtgtatgcttatatgagtgtatatatactatattatatacagtatatattatattgtagacattacatgatatattatatatgtaatagtcaccaaaagatgagtgtctgtggcagcagcatttctaaaggcccagttgaaaataagcgcagtgcccatcacagtatagtggataaataattcatggcatttttatgcaacggaatactatgctgaaaggagaatcaacacacagtgcatggatgaatgtcacaaatatactgttgaataaagaagctgatgctaaacaatgagtgctattcatacgattccatttatataaatgttcaaaaccagccaagatgaatctgtcctattaatcaggaaaatggttactgagaagtgggctgaaaggagagattttaaggctggtcctgttctgttttgtttttttttttctttttttccctttttcttttcttaaaattggagtgtagctctgttgcccaggctagagtgcagtggtgcagtcatataatagctcactgcatcctccaactcgtgggctcgaggggtcctcccacttcagtctcccgaatagctgggactagagataagcaccattgtgcccagctaaatttctgtgtatatgtctatgtctatgtctatgtctatgtctatgtctatgtctatgtctatgtctatgtctatgtgtgtgtatgtgtgtgtgtgtgtatatatatatacacatatatatgtgtgtgtatatatatatacacattatatatgtgtacacacacacacacacacacacacacagacacatatatatatatattttagagatgggatctcgctatgttgcccaggctgatcttgaactcctaggctcaagcgattccccttcctgggcctcccaaagtgctgagattacaggtatgagccacggtgcccagacttgttttgttcttgatctgtttgctagtcacatgggctatcagtttggaaaaatccaattacgtgtgcacttttctgtatgtaggtttagaaatgataataaatgccattataaagcacacattttaaaaggcgtttgcaggccaggcgtggtggctcacgcctgaaatctcagcactttgggaggccgaggcaggtggaccaattgaggtcaggagttcaagaccagcctggccaacatggcaaaaccccgtgtctactaaaaatataaaaattagccgggcatgttggtgatgcctgtaatcccagctactcgggaggctgaggcaagagaatcacttcaactctggaggcagaggttgcagtgagctgagatcacaccactgcacttaagcctgagagacagagaaagactctgtatcccaaaaataaaaaaataaaaaaataaataaataaacgtcatttgcaaagggccatccttcccaacagagacaagcgcctgctccctgacttccttggccttcccaggatctgactcttccctttcctttcaccccagatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 141766 - DNA, 865 bp, Homo sapiens
  Payload ID: 7873
  Gene Symbol: HSD17B2
  Gene Name: hydroxysteroid (17-beta) dehydrogenase 2
  ENST ID: ENST00000568090
  CDS Start-End: 205-865
aaaagaagccagccacaaagaggaccgatacctatttccatctatttaaaacaaaaatcaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattg

SEQ ID NO: 141767 - DNA, 551 bp, Homo sapiens
  Payload ID: 7873
  Gene Symbol: HSD17B2
  Gene Name: hydroxysteroid (17-beta) dehydrogenase 2
  ENST ID: ENST00000566213
  CDS Start-End: 152-551
gcttaatctatgctcagttgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggactgtgggctgtgatcaacaatgctggggtgcttggctttccaactgatggggagcttcttcttatgactgactacaaacaatgcatggccgtgaacttctttggaactgtggaggtcacaaagacgtttttgc

SEQ ID NO: 141768 - DNA, 984 bp, Homo sapiens
  Payload ID: 7874
  Gene Symbol: HSD17B3
  Gene Name: hydroxysteroid (17-beta) dehydrogenase 3
  Uniprot ID: P37058
  ENST ID: ENST00000375262
  CDS Start-End: 49-831
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccacttt

SEQ ID NO: 141769 - DNA, 1135 bp, Homo sapiens
  Payload ID: 7874
  Gene Symbol: HSD17B3
  Gene Name: hydroxysteroid (17-beta) dehydrogenase 3
  Uniprot ID: P37058
  ENST ID: ENST00000375263
  CDS Start-End: 49-981
tacacagagagccacggccagggctgaaacagtctgttgagtgcagccatgggggacgtcctggaacagttcttcatcctcacagggctgctggtgtgcctggcctgcctggcgaagtgcgtgagattctccagatgtgttttactgaactactggaaagttttgccaaagtctttcttgcggtcaatgggacagtgggcagtgatcactggagcaggcgatggaattgggaaagcgtactcgttcgagctagcaaaacgtggactcaatgttgtccttattagccggacgctggaaaaactagaggccattgccacagagatcgagcggactacagggaggagtgtgaagattatacaagcagattttacaaaagatgacatctacgagcatattaaagaaaaacttgcaggcttagaaattggaattttagtcaacaatgtcggaatgcttccaaaccttctcccaagccatttcctgaacgcaccggatgaaatccagagcctcatccattgtaacatcacctccgtagtcaagatgacacagctaattctgaaacatatggaatcaaggcagaaaggtctcatcctgaacatttcttctgggatagccctgtttccttggcctctctactccatgtactcagcttccaaggcgtttgtgtgcgcattttccaaggccctgcaagaggaatataaagcaaaagaagtcatcatccaggtgctgaccccatatgctgtctcgactgcaatgacaaagtatctaaatacaaatgtgataaccaagactgctgatgagtttgtcaaagagtcattgaattatgtcacaattggaggtgaaacctgtggctgccttgcccatgaaatcttggcgggctttctgagcctgatcccggcctgggccttctacagcggtgccttccaaaggctgctcctgacacactatgtggcatacctgaagctcaacaccaaggtcaggtagccaggcggtgaggagtccagcacaaccttttcctcaccagtcccatgctggctgaagaggaccagaggagcagaccagcacttcaacctagtccgctgaagatggagggggctggggtcacagaggcatagaatacacattttttgccacttta

SEQ ID NO: 141770 - DNA, 2683 bp, Homo sapiens
  Payload ID: 7875
  Gene Symbol: HSD17B4
  Gene Name: hydroxysteroid (17-beta) dehydrogenase 4
  Uniprot ID: P51659
  ENST ID: ENST00000256216
  CDS Start-End: 134-2344
gctcatcttcctaccagaaatcggcaagtcactgaccctcgtcccgcccccgccattccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttagaatttgtgatagcattgataagttgaaaggaaaattaaatcaataaaggcctttgatacctttg

SEQ ID NO: 141771 - DNA, 2686 bp, Homo sapiens
  Payload ID: 7875
  Gene Symbol: HSD17B4
  Gene Name: hydroxysteroid (17-beta) dehydrogenase 4
  ENST ID: ENST00000442060
  CDS Start-End: 80-1582
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaagcctacccaatgtgaggatgatgaggatgaagacctttatgatgatctacttccacttactgaatagtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttagaatttgtgatagcattgataagttgaaaggaaaattaaatcaataaaggcctttgataccttt

SEQ ID NO: 141772 - DNA, 2551 bp, Homo sapiens
  Payload ID: 7875
  Gene Symbol: HSD17B4
  Gene Name: hydroxysteroid (17-beta) dehydrogenase 4
  ENST ID: ENST00000414835
  CDS Start-End: 423-2213
aatggttattcttgaggcaccgcatctcttgaggaggaaagagccggaaacacctggtctctcaagcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttagaatttgtgatagcattgataagttgaaaggaaaattaaatcaataaaggcctttgataccttt

SEQ ID NO: 141773 - DNA, 2740 bp, Homo sapiens
  Payload ID: 7875
  Gene Symbol: HSD17B4
  Gene Name: hydroxysteroid (17-beta) dehydrogenase 4
  Uniprot ID: P51659
  ENST ID: ENST00000504811
  CDS Start-End: 185-2470
ttattcatgggctcaccgctgaggttcgacgggcgggtggtactggtcaccggcgcgggggcaggtgagcatgcgaaggttggaggccgcgccccttgctgaggcgcagctggctgctcttttcgggccggcatacgcgcgcagccgcagctgaggtcaccccgctgaggtggtggggaggggaatggttattcttgaggcaccgcatctcttgaggaggaaagagccggaaacacctggtctctcaagcaggattgggccgagcctatgccctggcttttgcagaaagaggagcgttagttgttgctttcaaaatctatgcaataaccctatggagaagatcatttcacaatgcagattctttgtttcaatgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttc

SEQ ID NO: 141774 - DNA, 2494 bp, Homo sapiens
  Payload ID: 7875
  Gene Symbol: HSD17B4
  Gene Name: hydroxysteroid (17-beta) dehydrogenase 4
  Uniprot ID: P51659
  ENST ID: ENST00000515320
  CDS Start-End: 80-2236
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcagtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgccc

SEQ ID NO: 141775 - DNA, 2589 bp, Homo sapiens
  Payload ID: 7875
  Gene Symbol: HSD17B4
  Gene Name: hydroxysteroid (17-beta) dehydrogenase 4
  ENST ID: ENST00000510025
  CDS Start-End: 176-2314
tctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgctttcaaaatctatgcaataaccctatggagaagatcatttcacaatgcagattctttgtttcaatgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttag

SEQ ID NO: 141776 - DNA, 2225 bp, Homo sapiens
  Payload ID: 7875
  Gene Symbol: HSD17B4
  Gene Name: hydroxysteroid (17-beta) dehydrogenase 4
  ENST ID: ENST00000513628
  CDS Start-End: 246-2045
aatagtgcctgactgtcttttggaagaagagttagtgtctttgatttagaattaagctaagaagagcttttagtttctgcttcccttgtaacaactggggtaaaaaagaagctgagaaagataggatttgctggcaaagggggcctatgttggtgcttttcttggtgctgcaacgggactgagatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattattttta

SEQ ID NO: 141777 - DNA, 2314 bp, Homo sapiens
  Payload ID: 7875
  Gene Symbol: HSD17B4
  Gene Name: hydroxysteroid (17-beta) dehydrogenase 4
  ENST ID: ENST00000509514
  CDS Start-End: 632-2056
gtaacaactggggtaaaaaagaagctgagaaagataggatttgctggcaaagggggcctatgttggtgcttttcttggtgctgcaacgggactgagatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaaggctggagtatggtggcatgatctcagctcactacaacctctgccccttgggttcaagcgattctcccacctcagcctcccaagtagctgggattacagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgccc

SEQ ID NO: 141778 - DNA, 1512 bp, Homo sapiens
  Payload ID: 7876
  Gene Symbol: HSD17B6
  Gene Name: hydroxysteroid (17-beta) dehydrogenase 6
  Uniprot ID: O14756
  ENST ID: ENST00000322165
  CDS Start-End: 111-1064
agcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttc

SEQ ID NO: 141779 - DNA, 1525 bp, Homo sapiens
  Payload ID: 7876
  Gene Symbol: HSD17B6
  Gene Name: hydroxysteroid (17-beta) dehydrogenase 6
  Uniprot ID: O14756
  ENST ID: ENST00000555159
  CDS Start-End: 178-1131
actccgctcccgaacccattcctcgcctccatcacctccaccgtagttgagccagcgatagtactgagagtagggaaagagcctccggtaataaagtttaagcagctcgggcagctcggtggggtcaaacgtctccattgagcgcggaactcgccacgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttg

SEQ ID NO: 141780 - DNA, 1751 bp, Homo sapiens
  Payload ID: 7876
  Gene Symbol: HSD17B6
  Gene Name: hydroxysteroid (17-beta) dehydrogenase 6
  Uniprot ID: O14756
  ENST ID: ENST00000554643
  CDS Start-End: 350-1303
tcccacttggtgcgcgcgggggctgcgggagacgcagcagtttgcgatctgcccacgcgttcgggcactagggccaccgctcttgtgggcagaaggccgcgtccattccaggaagaggatcttctccggaaatctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttc

SEQ ID NO: 141781 - DNA, 592 bp, Homo sapiens
  Payload ID: 7876
  Gene Symbol: HSD17B6
  Gene Name: hydroxysteroid (17-beta) dehydrogenase 6
  ENST ID: ENST00000554155
  CDS Start-End: 327-592
agtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagag

SEQ ID NO: 141782 - DNA, 1722 bp, Homo sapiens
  Payload ID: 7876
  Gene Symbol: HSD17B6
  Gene Name: hydroxysteroid (17-beta) dehydrogenase 6
  Uniprot ID: O14756
  ENST ID: ENST00000555805
  CDS Start-End: 375-1328
actccgctcccgaacccattcctcgcctccatcacctccaccgtagttgagccagcgatagtactgagagtagggaaagagcctccggtaataaagtttaagcagctcgggcagctcggtggggtcaaacgtctccattgagcgcggaactcgccacgctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttg

SEQ ID NO: 141783 - DNA, 591 bp, Homo sapiens
  Payload ID: 7876
  Gene Symbol: HSD17B6
  Gene Name: hydroxysteroid (17-beta) dehydrogenase 6
  ENST ID: ENST00000556650
  CDS Start-End: 366-591
acttggtgcgcgcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgaca

SEQ ID NO: 141784 - DNA, 1547 bp, Homo sapiens
  Payload ID: 7876
  Gene Symbol: HSD17B6
  Gene Name: hydroxysteroid (17-beta) dehydrogenase 6
  Uniprot ID: O14756
  ENST ID: ENST00000554150
  CDS Start-End: 360-1313
acttggtgcgcgcgggggctgcgggagacgcagcagtttgcgatctgcccacgcgttcgggcactagggccaccgctcttgtgggcagaaggccgcgtccattccaggaagaggatcttctccggaaatatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaa

SEQ ID NO: 141785 - DNA, 1190 bp, Homo sapiens
  Payload ID: 7877
  Gene Symbol: HSD17B7
  Gene Name: hydroxysteroid (17-beta) dehydrogenase 7
  Uniprot ID: P56937
  ENST ID: ENST00000254521
  CDS Start-End: 56-1081
ttccgaaagcagcggcggtgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataa

SEQ ID NO: 141786 - DNA, 666 bp, Homo sapiens
  Payload ID: 7877
  Gene Symbol: HSD17B7
  Gene Name: hydroxysteroid (17-beta) dehydrogenase 7
  ENST ID: ENST00000367913
  CDS Start-End: 13-348
gagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagctgaaggcctgctgacccagggtgataagatcactgctgatggacttcaggaggtgtttgagaccaatgtctttggccattttatcctggtaaagaagctgtgggcttaataagctaatatttcgtgtgatagtttctgtaaagctctgggcacagggcattattatagttgagcagccagttaactgatttaatctcatgtttgagttttcttgattgcatttgccttgtttattgtgagcatggaatacttctggaagctttcctagtagatttttctttaataaatgtactaatagtttttgatttacagaattactgc

SEQ ID NO: 141787 - DNA, 507 bp, Homo sapiens
  Payload ID: 7877
  Gene Symbol: HSD17B7
  Gene Name: hydroxysteroid (17-beta) dehydrogenase 7
  ENST ID: ENST00000367915
  CDS Start-End: 79-333
gaggcggcccgaaatcgtaggacttccgaaagcagcggcggtgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtatatctcttgctgatggattttttttctcatgtgattgtgcagcataacacttaataaaataagagaggaaagaaaaacctgaaaagaaacaggtgcggtgtaagcagttatgttgaggaagtctgtatagggtgacccattgtgtctcagtaccacgttttctttctttttttttttttttttaaag

SEQ ID NO: 141788 - DNA, 650 bp, Homo sapiens
  Payload ID: 7877
  Gene Symbol: HSD17B7
  Gene Name: hydroxysteroid (17-beta) dehydrogenase 7
  ENST ID: ENST00000466176
  CDS Start-End: 69-398
gaaatcgtaggacttccgaaagcagcggcggtgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggatgatcaagaaatggttgtatgtgatctgtgttgaagaccatgtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcag

SEQ ID NO: 141789 - DNA, 593 bp, Homo sapiens
  Payload ID: 7877
  Gene Symbol: HSD17B7
  Gene Name: hydroxysteroid (17-beta) dehydrogenase 7
  ENST ID: ENST00000470195
  CDS Start-End: 1-187
cagcctcgaggacttccagcacagcaaaggcaaggaaccctacagctcttccaaatatgccactgaccttttgagtgtggctttgaacaggaacttcaaccagcaggtgctgtattcgtctgtgtatgtcattaaatacctgcctcattacatggaggtgggtctaagtattaccattttcagatgaggacactaaatctcggagaaccttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaa

SEQ ID NO: 141790 - DNA, 990 bp, Homo sapiens
  Payload ID: 7878
  Gene Symbol: HSD17B8
  Gene Name: hydroxysteroid (17-beta) dehydrogenase 8
  Uniprot ID: Q92506
  ENST ID: ENST00000230236
  CDS Start-End: 28-813
gggattcccacccacccacagcccgccatggcgtctcagctccagaaccgactccgctccgcactggccttggtcacaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatccgctgtaactctgtcctcccagggttcattgcaacacccatgacacagaaagtgccacagaaagtggtggacaagattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 141791 - DNA, 990 bp, Homo sapiens; identical to SEQ ID NO: 141790
  Payload ID: 7878
  Gene Symbol: HSD17B8
  Gene Name: hydroxysteroid (17-beta) dehydrogenase 8
  Uniprot ID: Q92506
  ENST ID: ENST00000374662
  CDS Start-End: 28-813

SEQ ID NO: 141792 - DNA, 990 bp, Homo sapiens; identical to SEQ ID NO: 141790
  Payload ID: 7878
  Gene Symbol: HSD17B8
  Gene Name: hydroxysteroid (17-beta) dehydrogenase 8
  Uniprot ID: Q92506
  ENST ID: ENST00000414463
  CDS Start-End: 28-813

SEQ ID NO: 141793 - DNA, 990 bp, Homo sapiens; identical to SEQ ID NO: 141790
  Payload ID: 7878
  Gene Symbol: HSD17B8
  Gene Name: hydroxysteroid (17-beta) dehydrogenase 8
  Uniprot ID: Q92506
  ENST ID: ENST00000427295
  CDS Start-End: 28-813

SEQ ID NO: 141794 - DNA, 990 bp, Homo sapiens; identical to SEQ ID NO: 141790
  Payload ID: 7878
  Gene Symbol: HSD17B8
  Gene Name: hydroxysteroid (17-beta) dehydrogenase 8
  Uniprot ID: Q92506
  ENST ID: ENST00000422433
  CDS Start-End: 28-813

SEQ ID NO: 141795 - DNA, 990 bp, Homo sapiens; identical to SEQ ID NO: 141790
  Payload ID: 7878
  Gene Symbol: HSD17B8
  Gene Name: hydroxysteroid (17-beta) dehydrogenase 8
  Uniprot ID: Q92506
  ENST ID: ENST00000454191
  CDS Start-End: 28-813

SEQ ID NO: 141796 - DNA, 3519 bp, Homo sapiens
  Payload ID: 7879
  Gene Symbol: HSDL1
  Gene Name: hydroxysteroid dehydrogenase like 1
  Uniprot ID: Q3SXM5
  ENST ID: ENST00000219439
  CDS Start-End: 178-1170
acgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaa

SEQ ID NO: 141797 - DNA, 1493 bp, Homo sapiens
  Payload ID: 7879
  Gene Symbol: HSDL1
  Gene Name: hydroxysteroid dehydrogenase like 1
  Uniprot ID: Q3SXM5
  ENST ID: ENST00000434463
  CDS Start-End: 159-986
gcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgt

SEQ ID NO: 141798 - DNA, 459 bp, Homo sapiens
  Payload ID: 7879
  Gene Symbol: HSDL1
  Gene Name: hydroxysteroid dehydrogenase like 1
  ENST ID: ENST00000564998
  CDS Start-End: 249-459
gagggcgcggcgcggcagcagctccggcggccgagacgggggcggcggccgcgcgggtctggcgggaccggtttggaagactttgccggcctgcaggacacatgatgacattggacccaccctccccagctcggagtctttaactcagtcacatctacggagtccctttggccacataagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccg

SEQ ID NO: 141799 - DNA, 457 bp, Homo sapiens
  Payload ID: 7879
  Gene Symbol: HSDL1
  Gene Name: hydroxysteroid dehydrogenase like 1
  ENST ID: ENST00000562224
  CDS Start-End: 134-457
agctccggcggccgagacgggggcggcggccgcgcgggtctggcgggaccggtttggaagactttgccggcctgcagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgct

SEQ ID NO: 141800 - DNA, 549 bp, Homo sapiens
  Payload ID: 7879
  Gene Symbol: HSDL1
  Gene Name: hydroxysteroid dehydrogenase like 1
  ENST ID: ENST00000568857
  CDS Start-End: 217-549
agacgcagccccagaaaccggatcgctgcagcgcccctcggcgatcccaacatgatgtgtacaggtgactgcgaggcagtcggggggtctcacagtgggctccctggacaggactctgcgccttgctatacctccatctgaattgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacata

SEQ ID NO: 141801 - DNA, 2983 bp, Homo sapiens
  Payload ID: 7880
  Gene Symbol: HSDL2
  Gene Name: hydroxysteroid dehydrogenase like 2
  Uniprot ID: Q6YN16
  ENST ID: ENST00000398803
  CDS Start-End: 85-1122
gataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggagcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatcttta

SEQ ID NO: 141802 - DNA, 3350 bp, Homo sapiens
  Payload ID: 7880
  Gene Symbol: HSDL2
  Gene Name: hydroxysteroid dehydrogenase like 2
  Uniprot ID: Q6YN16
  ENST ID: ENST00000398805
  CDS Start-End: 228-1484
agggaccaggcttgggaggcgacgaagaggaacgctgggcgcaggaggcccactgcatacgcaggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatctttacataa

SEQ ID NO: 141803 - DNA, 3053 bp, Homo sapiens
  Payload ID: 7881
  Gene Symbol: HIC1
  Gene Name: hypermethylated in cancer 1
  Uniprot ID: Q14526
  ENST ID: ENST00000322941
  CDS Start-End: 1-2202
atgacttttcctgaagcggacattttacttaaatcgggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccgcggccgtggccccgggggctgagccgagcctgggcgccgtgctggccgccgccagctacctgcagatccccgacctcgtggcgctgtgcaagaaacgcctcaagcgccacggcaagtactgccacctgcggggcggcggcggcggcggcggcggctacgcgccctatggtcggccgggccggggcctgcgggccgccacgccggtcatccaggcctgctacccgtccccagtcgggcctccgccgccgcctgccgcggagccgccctcgggcccagaggccgcggtcaacacgcactgcgccgagctgtacgcgtcgggacccggcccggccgccgcactctgtgcctcggagcgccgctgctcccctctttgtggcctggacctgtccaagaagagcccgccgggctccgcggcgccagagcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcccgcctcttcctgtggttcgtcggccccctcccccggctccgcgctgctcttagagggggaggggtgtcactgtcggggcactcctagccctacctccggcccttgcgaccacacccattctcactgtgaatctccccgctggggtcggagcgtcgggcagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaagg

SEQ ID NO: 141804 - DNA, 3156 bp, Homo sapiens
  Payload ID: 7881
  Gene Symbol: HIC1
  Gene Name: hypermethylated in cancer 1
  Uniprot ID: Q14526
  ENST ID: ENST00000399849
  CDS Start-End: 161-2305
ggctgagacgcgaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccgcggccgtggccccgggggctgagccgagcctgggcgccgtgctggccgccgccagctacctgcagatccccgacctcgtggcgctgtgcaagaaacgcctcaagcgccacggcaagtactgccacctgcggggcggcggcggcggcggcggcggctacgcgccctatggtcggccgggccggggcctgcgggccgccacgccggtcatccaggcctgctacccgtccccagtcgggcctccgccgccgcctgccgcggagccgccctcgggcccagaggccgcggtcaacacgcactgcgccgagctgtacgcgtcgggacccggcccggccgccgcactctgtgcctcggagcgccgctgctcccctctttgtggcctggacctgtccaagaagagcccgccgggctccgcggcgccagagcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcccgcctcttcctgtggttcgtcggccccctcccccggctccgcgctgctcttagagggggaggggtgtcactgtcggggcactcctagccctacctccggcccttgcgaccacacccattctcactgtgaatctccccgctggggtcggagcgtcgggcagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaagg

SEQ ID NO: 141805 - DNA, 654 bp, Homo sapiens
  Payload ID: 7881
  Gene Symbol: HIC1
  Gene Name: hypermethylated in cancer 1
  ENST ID: ENST00000571990
  CDS Start-End: 366-654
aacctgaccttcacgtggggcgcgggaccttgcggggtcccagccgcaggcgcccctgttgtttccttcgggcggctcaggtgcgcgggaggaaggcagcggcctgccgcgcagagccctgcgcgcccgcgaggtggcgccatagccgcagcagcgcccgccggcccgggccgctccagataagagtgtgcggaaagcgcggcggggctgagacgcgaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccg

SEQ ID NO: 141806 - DNA, 1134 bp, Homo sapiens
  Payload ID: 7881
  Gene Symbol: HIC1
  Gene Name: hypermethylated in cancer 1
  ENST ID: ENST00000574370
  CDS Start-End: 1106-1134
tgcgagcagcggcgcgacagtgcggggtcccctttctcccagaagagacgtcacccacacaaacctgaccttcacgtggggcgcgggaccttgcggggtcccagccgcaggcgcccctgttgtttccttcgggcgggtgggttggagaagaagtccacgcgggattcttcaaaacggcgtacagggggattctagggccccatggttacttctttggaccccccggaggcgctgtccagccacttccagtcgccctgatgactcgtcgtgggttcctttaggagacccgaaagttcagggcgggctgtgtgggtaacacctctgcccaggttcccggagggccctacgtggctgcccctggagtatcccagagcgctagggctgcgggaaggggcgggtgtgcttctggaaacatgagcgcctgttagtatcagtgcctggatagggctggggacaaatcagtttatgccgcgcacaccgaatccatgcgcctgagtgagggtgggtgtgttggggagtgcgtccaagtggacagtgccgtacagtaatgtctacggggagttccaggagagctcggctactcctgcgcaggataacctctcccccaccacccgagtcccgtgctcgcgggcaggacttttccgaactggggctgtgtgcctagaaatacgtacatgggagcgctcagctcaaagccccagggtttctgggactcgcgtgtccggggtcggggtcccaggtgggtacaggtgggagggcgaacctgcgggtagggtgggcccctccccgcgggctcagcatctgtgcgcctccagctcaggtgcgcgggaggaaggcagcggcctgccgcgcagagccctgcgcgcccgcgaggtggcgccatagccgcagcagcgcccgccggcccgggccgctccagataagagtgtgcggaaagcgcggcggggctgagacgcgaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggcca

SEQ ID NO: 141807 - DNA, 725 bp, Homo sapiens
  Payload ID: 7881
  Gene Symbol: HIC1
  Gene Name: hypermethylated in cancer 1
  ENST ID: ENST00000576444
  CDS Start-End: 473-725
cttcccccaactggggcaacttctcccgaggcgggaggcgctggttcctcggctccctttctccctacttgggtaaagttctccgccctgaatgacttttcctgaagcggacattttacttaaatcgggtaactgtctccaaaagggtcactgcgcctgaacagttttcttctcggaagccccagcacccagccaggtgccctggggcgtgcaggccgccctggcctcccctccaccggcggccgctcacctcctgctccttctcctggtccgggcgggccggcctgggctcccactccagagggcagccggtccttcgccggtgcccaggccgcagggctgatgcccccgctcagctgagggaaggggaagtggaggggagaagtgccgggctggggccaggcggccagggcgccgcacggctctcacccggccggtgtgtgtccccgcaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccg

SEQ ID NO: 141808 - DNA, 812 bp, Homo sapiens
  Payload ID: 7881
  Gene Symbol: HIC1
  Gene Name: hypermethylated in cancer 1
  ENST ID: ENST00000571875
  CDS Start-End: 614-812
aacctgaccttcacgtggggcgcgggaccttgcggggtcccagccgcaggcgcccctgttgtttccttcgggcgggtgggttggagaagaagtccacgcgggattcttcaaaacggcgtacagggggattctagggccccatggttacttctttggaccccccggaggcgctgtccagccacttccagtcgccctgatgactcgtcgtgggttcctttaggagacccgaaagttcagggcgggctgtgtgggtacaggtgggagggcgaacctgcgggtagggtgggcccctccccgcgggctcagcatctgtgcgcctccagctcaggtgcgcgggaggaaggcagcggcctgccgcgcagagccctgcgcgcccgcgaggtggcgccatagccgcagcagcgcccgccggcccgggccgctccagataagagtgtgcggaaagcgcggcggggctgagacgcgaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggacc

SEQ ID NO: 141809 - DNA, 6711 bp, Homo sapiens
  Payload ID: 7881
  Gene Symbol: HIC1
  Gene Name: hypermethylated in cancer 1
  Uniprot ID: Q14526
  ENST ID: ENST00000619757
  CDS Start-End: 161-2305
ggctgagacgcgaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccgcggccgtggccccgggggctgagccgagcctgggcgccgtgctggccgccgccagctacctgcagatccccgacctcgtggcgctgtgcaagaaacgcctcaagcgccacggcaagtactgccacctgcggggcggcggcggcggcggcggcggctacgcgccctatggtcggccgggccggggcctgcgggccgccacgccggtcatccaggcctgctacccgtccccagtcgggcctccgccgccgcctgccgcggagccgccctcgggcccagaggccgcggtcaacacgcactgcgccgagctgtacgcgtcgggacccggcccggccgccgcactctgtgcctcggagcgccgctgctcccctctttgtggcctggacctgtccaagaagagcccgccgggctccgcggcgccagagcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcccgcctcttcctgtggttcgtcggccccctcccccggctccgcgctgctcttagagggggaggggtgtcactgtcggggcactcctagccctacctccggcccttgcgaccacacccattctcactgtgaatctccccgctggggtcggagcgtcgggcagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaaggaccccgaccccgctgctctcttctgcccctgcacaaggacctggatgggctgcgcccgctgggtggaggagccagaaagggccaccctcacacaggtgcagaggcttggacctgcctccctccccagtcccagaaacagatcagcaagaggtcaggtatgtttcataactaaaaatttattaaggaaacaaaaccagtgctgcaaacgggacagaaaggagagctgggtctccctcccgaccacccagtcatcggccttccagctggggagagaatcttaaaggagaggccggggaccctgtactccaaagagcccagtcttctgagactctaggggactcctacccccaaactactggccttggctcccctacacggtaccccatcgcttctggcatagtcctgggcctcagggagggcagagctgcgcacccatcctccaggcaggctgtgcagtcaggccatgggctctggggtatcccccactggtcccattaagatttgcccctggctccaccgaaaaccccgtcttcccctaagttgtccttgtctctggccctgggtttcaggaactcattcttggtaaggaagcctccccactgaggtaccagctaaaggggcaaggaaagggcccctgtgtcagtgtcagtttttccggggagtgagggcaaagctagaaaccaggttaggcgacggtgccccagcactggaatgcctcaggctgggctgtccacgcctggaagtttctcccagcacaggagccgagggtggaaggccctgggtgggagacctgtactaggttcctgccatgggtagtagagagggaaagttcagagtgagaacccctatgacgaggaaccgcggtgaagaaatgaaggggatcagggaggtgaaaaggatcaactagaaggggaagaagggtgaggggctattctggagggagggtaggcgggcaaggaggggtgaagggggagctgaggggagtcaggacatttcctgaagaggaagctagacggaaagaaaggccagtgaggagagagggagcaggtggaggccacccgagagcacgggcctgagaccagatgcccctttcctctagactcatgactgtccacggggacgcaactggcgaagtgtgagggacccaggttgataagggcaggaagaggagcagcaggaagggtgtgtggtaagtctggggtggatggtagaagaggtgggggcccagggctgctgttagggacatgctgtctagaagccgacttgggttcatgggcgagtccaggcctcagggagactggggacacacaccctgggcacttcttcctgacttaaccaaagcctcttgaacacattcacgacagaggttctgaagatgaaagggaactgtgatttcactgcatctgacggaaactcagaacccctgccctgtctccactggagaaagtggctgcgtccccaggcgagaaggccctccctcagccttggaatgagacgggggagggagaaaggctgagagcatgggcggcctatctggcttgcccagctgctgttgctgtagccagccacctccctgctaaatcctggcagcccaggagggtcccagcagcttccgcccgatccttgggaggggctctgtgaggagcaggtcccccacagcatggccgtggcgtgggttggaagaggatggtttattgtctgggtggattggtggctcaggcacgtgggcatcttccgtgctacactgggcgcctggtggcctttcaggaacggttccacggggggggggccccagtgtggctccctcagcccacctgggcccacgtgaggaaggctgggatgtcccgtacaggaacattccttgtgagcgccttcacacgcaggttccggtcatccgtcaacagcaccacctcccgcagtagccggattggctcctctgtgggcatgagagagcagaaggctgtcactgaggacaggaggcagagggctggctgctcttctcaccctggagaatgtggtcctggggagggggtgccacgctagccgtgtcttggctcttctaccagtcctttcctccgtccgggctctcagccccggggaccctcccctgctggcctagagagggctgcactgggcttctgccttgactccggcctcccatacaggactctcttctgcctagttcccaaaagctgcccaaacccgtcagcctcccaggaccctaaactgagggaatagaagcagccccttgacctctactcctttttaccacatggctggcccccagatcacaacaccgctctccccacaccccacttttttttttttaacaagtcctctccctctaaaagccagcaggttgaagctttacgcatccagaggcagaaaactaaagatggaacagaaaatgtatccagggttttccagatgtggggagaggggttaagggagccctgaggagaggagagggtaagggtcttggcagaattgtgccaagggcacaccaaggctttggccaaccggtcgcccctgctaagtaacagtaatccatgtatacaggcgaaagtctctaagaggacagaagagtaaaaaggaagagtagagttaagatgatgatcccagttctccgtcttgtaccccagggaagacctgtgtatccttccaggtttctttaggcacatttacaagtacatacacttggacatataacctttttttcctacagcatcatgatcatattagccacactttcagagtatatacttaaaaggtcttgctatagtggcacagatatctttcattctttttagatgactttttttttttttaagcacagtctctccactacctctctttccctaactccctaatctttaacacattggagagaatttaagccagggacaagcactcacacaagtgacatccctaccctgacaggcctgcttgggtggcaggtctactcgtcagtcccaggctgggcatttcctgacagaggtccaggtccggcagacagcaaggcacaggaagtgtcctgctgtgctcactgactgcgtgggctggcgggggtggggggctgcaaatatccatgtcggacctgagcagtctcaggcttgccagctccaggcagggaggctgagaactggctttcagcctggggaggagtttggaggattcgggagggagaggtttgtggggttggtggtggcgagagaagaggacaggaggaaggagagtgtgaagggaggcaaggggctgtgggcagaggggaaaggaaggtggcctcgggtgaggggatactcagagactactcagctgcctgggccaggcccctctgcagataagtgtggctggggtggtggtatgcagggctgtgtggggctcccagctgactggctgcgtctgtagcagccccactattcctgccctgggcctcaaaccaggagcgtcccaggccttaggtcagctaaccaaggcccgacattgctggcaggggtctgcaggggtttctgtggatactttgacatttttcacaataaacatcctctgttttga

SEQ ID NO: 141810 - DNA, 4734 bp, Homo sapiens
  Payload ID: 7882
  Gene Symbol: HIC2
  Gene Name: hypermethylated in cancer 2
  Uniprot ID: Q96JB3
  ENST ID: ENST00000407598
  CDS Start-End: 196-2043
ttttaaaaggcagtggtagggtagagggtggcagtggagacagctggagagcactgaggacgcggacccacgggtactgtgtgagctgtgaagcccgcttgggagaccccactgccagccaggtgaccaggcattgatgcacccccaggaaggccacgcgctcaggagccccccccgccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaa

SEQ ID NO: 141811 - DNA, 6798 bp, Homo sapiens
  Payload ID: 7882
  Gene Symbol: HIC2
  Gene Name: hypermethylated in cancer 2
  Uniprot ID: Q96JB3
  ENST ID: ENST00000407464
  CDS Start-End: 231-2078
gtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggagccccccccgccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaa

SEQ ID NO: 141812 - DNA, 6940 bp, Homo sapiens
  Payload ID: 7882
  Gene Symbol: HIC2
  Gene Name: hypermethylated in cancer 2
  Uniprot ID: Q96JB3
  ENST ID: ENST00000443632
  CDS Start-End: 373-2220
ggccaagaattgtgtgtctgccaccagcgccccctggcctaggtggcccctgggtgtccttaatctcctgtgtgtgttagaggggcaggcattgcacccaccgaactccctagacctgttcgctggtccttactcttcctggctgtcagatccaactaccaggctctgtggccacagtctcctgctgggctgcccctggtgccccagccagagacccccaggtgcgtcccttcatcgcccttccctcccttcttcgctgatggctgtctgggtgactgtgttcgtcttctcttccccaggtgaccaggcattgatgcacccccaggaaggccacgcgctcaggagccccccccgccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaa

SEQ ID NO: 141813 - DNA, 9885 bp, Homo sapiens
  Payload ID: 7883
  Gene Symbol: HCN1
  Gene Name: hyperpolarization activated cyclic nucleotide gated potassium channel 1
  Uniprot ID: O60741
  ENST ID: ENST00000303230
  CDS Start-End: 242-2914
ccagccgcaccggagcccggaccgcagccactaagggcagcggcggcggcgggagccaggcgcgcagctagcagcggcgcggtcgggaagcagcagccgccgccgccgccgccgccgccgcgacgggcagctgggctcgccggcagccggctcgggcccctaccctctcggctacgtgtctccggcgccgggcggccggcgagtctggagcccgcgccgtcgccggccgcgtcctccgggcatggaaggaggcggcaagcccaactcttcgtctaacagccgggacgatggcaacagcgtcttccccgccaaggcgtccgcgacgggcgcggggccggccgcggccgagaagcgcctgggcaccccgccggggggcggcggggccggcgcgaaggagcacggcaactccgtgtgcttcaaggtggacggcggtggcggcggtggcggcggcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcacttcgcattgtgaggtttacaaaaattctcagtctcttgcgtttattacgactttcaaggttaattagatacatacatcaatgggaagagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccactctccgcctcgcagccctcgctgccccatgaggtgtccactctgatttccagacctcatcccactgtgggcgagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagattatttatttctaacctacttttacttaagtcctttgatatgtatatttctctattttatgaagagttcttggattcaatggaaacaaaactgattttaaaaaggcaactcaaatgaactagtaaatagcaccaatcaaaactttctttcattagctgtgtctctgcatctaaattgttaatcattaatggtggagaattaaataacaaatcccattttatagatctaaattgtatttcggtgctttcaatttcaaattaggttaaagaatgcactacttgcttggccaccgtaggagactagcattgccactgtttgttaagaatatcactaacctcaaacatgttcattgatctttcagaaagctgagggaaaattaatatttgtcttcatgtgttatcggacttttaccaagactcgatcaatgttagttgtaaataactttttcaacccaaataaaaatagctattctgtgttgtatgaaggtaaaagtcattgtttaagaatttagttttattgcttcacttcaaaacttagagttttaaattttacaaaacctgattgtgagaattattcaattgtaatgcaatggcttgaaacctacaatattattttaacctgcaatgttttatgcaaaattgtatgctcgaatctacaaattgcttgtattacaccaaaaatcgttacttttctttcttcttgccataatcaagcatctgaaaatagtccctgcatgcttctggggaaaaaaaaataggttcaaatcagtcattgtagagaaaggcttacagtatttctcgtttctagaaaagcataacaattcattaattgcctatcttataattcctataaggctgacttggatctctgacttaagtctagaagtgaggttttcacttttatttaatattattgctattattatttaaataattatttgtaaaccacagcttgatttggagttaagtgttgtctgtgtcttcactgtagctggtaatttactatggtattaatttaaagaaataaattcaatacagcatcacgtctgtttgggaacacacattttgctctatgtatattgtaactaaatggttagtaaactttaaggcatgtggtgactaacgtagcccttagataggaggtttgtcatttttaatgtgttgaaaatagtacagacatggtgacagaaagcaggggtaaagttgaacgtctatgagcattgtctgtctgttttcttaactctttacatgatctgtgagcacctgcttcttctcaaagaactcccttagtaatcatttgtgcctaatgcatcccacacatgtggagtatgactggaacacaattgaaagattcctaacaactggctgcggtaaataacccaagttaagagcatgacttaaagtggaggtcttcagtatctctggcactggcaatacatttaagaacatacagagatcacacattatgtgggacagggcctgcagatagacttgaggacagaaaacaaaaacaaaagcagaaactctaaagtggatccttgctgcctgttatgccttttgtggatataatacctataataccaaaatgagttgttatgtttaatttcaaacaaatcccaactggtgtggaagtaattaactgctagtcgatgtaatgtaatcatcaatatgctggtgacatatgatggcatgtcaggaatactgttgtaagaaagggattgttcagtctacctagaacctatgggaaagctgcaagaccatttacatatcagtacaaaactcctttattttattaaaatatgagaattaacttcaatttattaagattacgtattggtcctttaaattattaaaggtttacatttgataggattaatggatttggtagtgaaatatttttatatatataaatttttggttttttattttgagcactattgggaaacataagcaaaattgaaatgcatggtctttcagtgcaaccatacaatttttattcactttgtaatagaatggacaaaaaaactaaggtttatatattaaactaataaaaaggtacagggtaaattatatacatatatgtatgaatgtatatatacttagattaagaaaaaaaaatgactcacattcctgtaatataaaggtccattgctagttgaaaagtgacctcttttctctgtacatagtgaagcccgtatgtatggagttttaatctgtacagaaagaaatgtattattcattggtctttctgctgctggaaagataatagaatagctgattcttacaacaactgtatgatcagggatgagttagagtatttcttttgtctttgctcaaagccatacatatataaatatatataaagattattaataaattcaacaaaaaataaactacaatcatgaatattttattttatcaatatatgctaatcaaatgttttattttattaatgagtacagctttgcctctatttttacatcataaaatttccaagagcttatacttgataatcacataaaatcaattatattctataattctggaatgagaggactttaaatagaacatggatttttcaaccacttctttgtttacctttttcgtatagtaaaatatgagcttattttcttttttgctctgtgcctttttagaatgtggttgttctccaacttcaaaacacaaccattttgtgtaattattggatatacagatgagaaataattttcctgtaataatggtaaataattgtcctgtaatatatttatacaaacctattttgttataatagttctatgacatacctattttgttataatagttttataacatacctattttgttataatagggccttgggctctattataacaaaacaggtttatataaatacattcatatttatagccttaaacaaaataggtttgtatagtaggcccaaggccctattataacaaaataggtttgtataaatatattcatatttatagccttgggccctgcaaagttatttggagagtgatagaacctccccacacaagtgggttttaaatgatacctaaaagcctgagatagagtttatcataatgagaataagtagtgaagcattcctgaaaacaaggaggataaatagtagcaatggcaatatattctattcaccaaaaaagtagcttgtctccaggtctggatgacctcttcataagtgaacaattccctgatgaatgctgttccactttaaagagatggttattttgcaatttataaacttaactgagcatactattttcaggacactacaaagtacatagtcaagttattaccgtcattcctataggacagagaatgatttaaacaatatgacatgtttaaaattttagatgatttatttcaaatcctgaattatgtctacttcaaattatgagcaatctctattatctttcaggactatttaaaaaatctccatacctcctctttcagcttaggtttttatatttgttaattttactatgttactttgcttctatggccctcacttgcactgtttataatgttaacctgtttgaatgagatatctctccattatatctttatctttttagaacatgtgccataaaacccatgtggttattttgttcatatgcactacaactagcaaacttttattttatgttcacctactttaaaaagtactcatactgtaccatgggaaagaaacatgggccttatagaatggaatgctgagctattttgagtcctgaaaacaatggccaaaaatttaaggaactgtggttgctgcatgcaccaaattgtagcacatacaaataaataaaatacagttctataactgtattcaatatggttattttcaaggaaaaataggatagaaattttctttgaaagatttgctattgtacttagggaagtacacctgctattacccctcaaaagcaatgactttcttaagcaatttcaatttttttcctttttaacaaccctgcacttgcacaaccctgcatctcttgtctcaccctaatgctgaccctgcttccaattcaggctttgacagggacaaatggagattttaaggttttttaatgagagaagccttgctgacactccccgcatcccaccttgaaaattatttaaagatgatcttaaaagaacctacagataatgctctgaatttgtttacaaggtccttgatgtggagagaatgagtaatacattaaatgctggggaaataattatcatttagtgaaaaattaagcatgcttttctaaaatgtggatgtttaacagagcacagctgattgggaacactggcagttcaatgcagctggagtgtctcacagggtgaagaggaacccagatcaagtgggaaatagggatttcaaaaaccttctgaaaggcttttaacatcagggcaaaggttttacagtgttgtactttatattcttaatttaagcttatcaacggggaggattcacattgaaatgtctgttttgctaatgtaacaaggaataaaataatttatgacacagcaaaaactgggggctatttacaaccccaccctgccttgtgaggatgctgggtcctaaggaaggtcctaggtttgctaaatagagtaatgggaataggaaactgaaagtttacttgctttgcgtaagataatatattgcggcagggaaggggtacaagaagataagagctagaacctgtgagaagggaaagaagtgataaaataattttggctaaaataaagcaagttctcaggccaggcgtggtggctcatgcctgtaatcctagcactttgggaggccaaagtgggaggaatgcttgaggccaggaattggagaccaaccagggcagcatgtcaagacctggtctctacaaggaaaaaaaatttttttaattgaccagtatatacttacatacctgcagtgtttagaaaacccgactataggtggtgtattcctgtagtcctagttactcagaaagttaaggcaggaggatcgcttgaacttaggaggtcaaggctgcagtgagccctgttcgttccactgcactccagcttgggggacagagcaaaaccctttctcaagaaaaacccaaacaaacaaaaaagtgaagccagttctttaatttctattggagatatcacacacgctccaaagagtggcaaaggtgaacattctttggagctattatatttctaatgtaacatcaatggccatttactcccaaagggaaacatctttttttttttttttttttaagatggagtctggctctgtcacccaggtgggagtgcaatggcaggatcttggcccactgcaacatcagcctcccaggtttaagcaattctcctgcatcagcctccagagtagctgggattacaggtgcccgccaccatggctagctaaatttttgtaatttttagtagagacagggttttaccatgttggccaggccggtctcgaacccctaacctcaagtgatccgcccgcctcaccctccagaagtgctaggattacaggcctgagccaccgcacccggccctgctatttttttctatgtagttgtttcagtaataccatatgagcagagaatactattgattcattcaattgaagaaatctgaataaattagtaaatataataattcttcaaaagaggaccactttatgtttccaatagattatataattgaattcaggtaacgtagagttattcagacttttttttttaaataacggaattttgcaaaaaaacaggttgcatcgttttctacagagaatattcagatgtgtagaggcaaagagactttcttgaaaggtttttatttcctgttaaatttgtgaggaaaactcctgagaaaggaaagatttacttttgaaggaagaaagaacataacccaaagaaatttgaaagattcaaaaagagttttccaaatgtattctcatttctttctcatatttgttcaaggtcttagtttccaagcattcaaaattaaatcttgtttgcctaactcttctaacatctattaccaacctaacatattacaattctgtttaaaatgtgcagttctaaatgttcttgcgtgcctcactgtggaaagtgtggtgcatggaactgcagcgtcagtatcacccagaagtataattacaagaagtgcagagtccttggccttaccctgtacctacagaagtccgcttttgggcaagatccccagatgattcatatgtgtattaatattgaaaaaattggaactagtaagtcctagaggaggtaaattttaagggctttttaagggaacttccaagtgtgaagacatttctggagatgacaagtcaacatagcatgggatcttggctagacaaggaaagcgagagaacattaaataaacacaagcaacgacaaaccacctatgttataattttatcctggaccatccaaagtttactcttggtcacgctgtctaacccagcctgcctcctggcacttgctagttagaaccagggaagagaaaactaatatgtgttaggtattataatttccttatgtcacataaattttggtgccatagctagcaatgtttcttaatatcacatcagtacaatgtgtccattgccttctgtaacatttttaatgctatcaataatacattgacattataaaaataaatgaatgtggtcaa

SEQ ID NO: 141814 - DNA, 4738 bp, Homo sapiens
  Payload ID: 7883
  Gene Symbol: HCN1
  Gene Name: hyperpolarization activated cyclic nucleotide gated potassium channel 1
  ENST ID: ENST00000634658
  CDS Start-End: 406-1293
aatgtcacgctgggcagaagtagagcaagagtaacgagcatgtgtggagagcggacggggagagaccctttctggccaacagagggcagccgaggggaggcgctggggcgcgagggctgagccgagctgagcctcgcctagctccggcagcctcagcttcagcaccagccgcaccggagcccggaccgcagccactaagggcagcggcggcggcgggagccaggcgcgcagctagcagcggcgcggtcgggaagcagcagccgccgccgccgccgccgccgccgcgacgggcagctgggctcgccggcagccggctcgggcccctaccctctcggctacgtgtctccggcgccgggcggccggcgagtctggagcccgcgccgtcgccggccgcgtcctccgggcatggaaggaggcggcaagcccaactcttcgtctaacagccgggacgatggcaacagcgtcttccccgccaaggcgtccgcgacgggcgcggggccggccgcggccgagaagcgcctgggcaccccgccggggggcggcggggccggcgcgaaggagcacggcaactccgtgtgcttcaaggtggacggcggtggcggcggtggcggcggcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcacttcgcattgtgaggtttacaaaaattctcagtctcttgcgtttattacgactttcaaggttaattagatacatacatcaatgggaagaggtaagatgcatctttttcttttttaaatctatatcatgaaattgttaattatggctgttttacaatgaacaactgtgcaatgtgtaatgagttttatgaaattcaagtagaaaaatgtattcgacgactcttttccatgcataagtgatatatttgtatccctaaaatatatgatcaaataatggatttgaatgaactgaaaaaaatagtgatcgttttatgccaatttattttatttttaaataaatgcactttaatcagcaattattatcttgatcaatacaacccctttcccaccttggttttttttaatctaatataaatacatcaagtaccattattttgataaagatgtgtagggtctgattgctaatctggcacatcattagctctgtgagatagtgtggtttttgtatcctctaatattgaagtttcattgaattcatgattgggtaaaacagattgtttctttatttccaaattgtatatataaaggctttgattttagcatattaattttgcttattgttatgccttgcctatagtaacttattttagtttctccctattagttcatttcataatactaaaaaggaacatattcatgagggacattagtacatagaaaacacaaagagtatagtgaataaatggagtgaatctgaccaatcaggcccatattttgctgaatagagcatctgttgttaggcagtgggtgggacctgagagggctcagccaactggagtttccaaagatctgagttaaaccatcatcaagcaaaggagttcatatccctatcttcaaagtctgaatattaaccattttgacttccttttcttcctaagtctttttgtattaattataacctgaattttatagtctgcataagcgtaagagtccaaaagacttgtagaatgcctaaatcgacactaatgaaagtcatataaagtcatatactggctatagaatattgctttcctccctacagaaatactttttagcattttcaagataaattatgtttttaaatatgtcataaaatggaagttctgtttgatttctgtgaggcggtagcagtgtttttgtatgtgcttgtcagtgacattttggttcacaggatttcaggaaatgacatgcaataataaaacactgcataatacactgataaaaaggcataaaaatggatcattcttaaaatatagatatgggatatatttaaaatcaaatgaagcacatttgagaaatcagattcatcttgtaatttttctctatatagcacattccatctaaaatggaataaatgttcagttctcaaagcctttttatgctaatttgagattaataccaaaccaagatgattcttgctaataattgctaatatttattgaaggcttattacacgtcagctagtatgtttgattctttacatatattagctcactgaatcttcctaacaacacaaagatgtaaatataattattgtcattattttacagatgagaacaattaaatacaataaggtaactcgtccagattcatagaactagtaagaagtggagctgggattccaaacttggcaatcagactcaggagccagtgctcttaactgcaaaactatataggttcttactatgatatataatgttttagttataaatatcttaatattctaccattttatagattgtctaacgaattatagggaacttttcttaagtaagactgtgggccatgcaatacaacagagttgaatagtacctcttaaaacaaggccatggaaaaatattttaacaaatatcctgtgagaggaaagtcactgatataaacatccagtcaattaaaaatacagtagcaatgtgactatttttaatatcttgtggttttagcccagttaccctagagaatggcagcaggatgaacagatggcatcctatcagataaaatggcaggccatgtggtcatataagagtatactccttaccaccaatgtcctttggcttctggcagtaattacaggcacctagatctgtgtaacatgatgtgttttaaagatgccatgataaaatttaggaacatcagctcactgctatcattattgtaaaatgcaatttaatatgcacttacagacatttggtaaccaagcacattcaggctagagttgtgggttggcaacatgtttcttataaataaatgaccttggtaataaatgaaccataagcccatttaggtgaagaatgttttcttgattatatgatacccccatataatatcatatatcatgggtatttaatgcccattagtaatgctgttcaacagggaagaaacagagtcataatccagaatttaatacaaattaatctttccatcacctacatgtttctaaccataatctccaagaaacttgaatggttccaaaactggaaatctctctacctgatttttctaaatgtcaccaggatgtgtttacaagtaaaaatacaacaaataaatcagaaaaagtagctctgtgagcttttgcaataaaaattcagaggaagatgtgagttcacccacatgtctttggttctgggtgttttagtatcaagctggctaatgctaaattcagcaaatttggggaagtaatgtgtgaagtctggaagctgccactgttctaaatgaatcattcctgaggaaagctgctgccttctataggaagctgcttccatcttcaacaatacatttttttttttctggactgaattagttcaactgaaaaacaacaagaagccctgatgccagataaattagaaaaatattatgaatgagatacagaagctttaaatttttgtgcttatgttattatcattactaaagctgaattagtggttaatacaggaggaaaaaactgatttgagcaactaatttatgaaacacatggtgttaagaagtgaggagggaagttgttttcatgaaccaattataagatcaatagatttgggatgtaaaaatagctttctgtgacattacactgaaactttatatatattgccaggtgaggtaaaaaccagagacaatttagataaatcaagccagaaatttcttttcttgtaatagctagaaagctgaggtgaatctttccaatttttatgtttggttttaaaaaactattatttgaattcagcattgtcgttgttgttattgtgtttaaagacagtgatccaagccagactgctatttcataacctatcacaagggtaacaaattccttgtgatcttcctaaaagagacatacggtgaggaaatccctggaaattaaatggaatatgtgacaatcacaagccactgaagagataaagagtagattaagggcttagtgaataggagattattcagtttgtaaaggtgaagagttcctttacagctgctgatctcagtcattttatcaacaggagatgaccttcgaaattttttagaggtttaggaaatattaattgcaaatacaaa

SEQ ID NO: 141815 - DNA, 3408 bp, Homo sapiens
  Payload ID: 7884
  Gene Symbol: HCN2
  Gene Name: hyperpolarization activated cyclic nucleotide gated potassium channel 2
  Uniprot ID: Q9UL51
  ENST ID: ENST00000251287
  CDS Start-End: 54-2723
ggccggcggcggcggcggcggctccgctccgcactgcccggcgccgcctcgccatggacgcgcgcgggggcggcgggcggcccggggagagcccgggcgcgacccccgcgccggggccgccgccgccgccgccgcccgcgcccccccaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtgaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcggggagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaa

SEQ ID NO: 141816 - DNA, 3718 bp, Homo sapiens
  Payload ID: 7885
  Gene Symbol: HCN3
  Gene Name: hyperpolarization activated cyclic nucleotide gated potassium channel 3
  Uniprot ID: Q9P1Z3
  ENST ID: ENST00000368358
  CDS Start-End: 9-2333
tgggcgccatggaggcagagcagcggccggcggcgggggccagcgaaggggcgacccctggactggaggcggtgcctcccgttgctcccccgcctgcgaccgcggcctcaggtccgatccccaaatctgggcctgagcctaagaggaggcaccttgggacgctgctccagcctacggtcaacaagttctcccttcgggtgttcggcagccacaaagcagtggaaatcgagcaggagcgggtgaagtcagcgggggcctggatcatccacccctacagcgacttccggttttactgggacctgatcatgctgctgctgatggtggggaacctcatcgtcctgcctgtgggcatcaccttcttcaaggaggagaactccccgccttggatcgtcttcaacgtattgtctgatactttcttcctactggatctggtgctcaacttccgaacgggcatcgtggtggaggagggtgctgagatcctgctggcaccgcgggccatccgcacgcgctacctgcgcacctggttcctggttgacctcatctcttctatccctgtggattacatcttcctagtggtggagctggagccacggttggacgctgaggtctacaaaacggcacgggccctacgcatcgttcgcttcaccaagatcctaagcctgctgaggctgctccgcctctcccgcctcatccgctacatacaccagtgggaggagatctttcacatgacctatgacctggccagtgctgtggttcgcatcttcaacctcattgggatgatgctgctgctatgtcactgggatggctgtctgcagttcctggtgcccatgctgcaggacttccctcccgactgctgggtctccatcaaccacatggtgaaccactcgtggggccgccagtattcccatgccctgttcaaggccatgagccacatgctgtgcattggctatgggcagcaggcacctgtaggcatgcccgacgtctggctcaccatgctcagcatgatcgtaggtgccacatgctacgccatgttcatcggccatgccacggcactcatccagtccctggactcttcccggcgtcagtaccaggagaagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggagatcattaacttcacctgtcggggcctggtggcccacatgccgctgtttgcccatgccgaccccagcttcgtcactgcagttctcaccaagctgcgctttgaggtcttccagccgggggatctcgtggtgcgtgagggctccgtggggaggaagatgtacttcatccagcatgggctgctcagtgtgctggcccgcggcgcccgggacacacgcctcaccgatggatcctactttggggagatctgcctgctaactaggggccggcgcacagccagtgttcgggctgacacctactgccgcctttactcactcagcgtggaccatttcaatgctgtgcttgaggagttccccatgatgcgccgggcctttgagactgtggccatggatcggctgctccgcatcggcaagaagaattccatactgcagcggaagcgctccgagccaagtccaggcagcagtggtggcatcatggagcagcacttggtgcaacatgacagagacatggctcggggtgttcggggtcgggccccgagcacaggagctcagcttagtggaaagccagtactgtgggagccactggtacatgcgccccttcaggcagctgctgtgacctccaatgtggccattgccctgactcatcagcggggccctctgcccctctcccctgactctccagccaccctccttgctcgctctgcttggcgctcagcaggctctccagcttccccgctggtgcccgtccgagctggcccatgggcatccacctcccgcctgcccgccccacctgcccgaaccctgcacgccagcctatcccgggcagggcgctcccaggtctccctgctgggtccccctccaggaggaggtggacggcggctaggacctcggggccgcccactctcagcctcccaaccctctctgcctcagcgggcaacaggcgatggctctcctgggcgtaagggatcaggaagtgagcggctgcctccctcagggctcctggccaaacctccaaggacagcccagccccccaggccaccagtgcctgagccagccacaccccggggtctccagctttctgccaacatgtaaaacctttgagtacatccagccttagttcttggggtgcagtagtatgtacccaagggcagatgcctcttggggaaggccatggggacctgaaacattgccccatggaaatgtcgaccctgtgcggacattccgcatactgccatgaagacggtctctgtgtcctcagctcaagaatcctgtagcttgtcccatcataatccattcacccgttcatcatgtgtactgagcagctaccatgttcaaggtaatatgccaggcgctgtatgtctccactgccaagtagaagtgactcaaaaccctctgacaaggatattcccttggctatggtcctgccaggtgcaggcccaggcccatgaccccacctttactaagcacaagtacttgccactgccatcactgccaagtaactagatgtctctgtttccctgccaatgatcctgcaggttctgcccggtctggttatcttcctgttcctgtagcatagccaggcactgccagtcacctgtgcccccattgctgtcagcagatgtcttgggtcctgagtgtgggtatccacttttacccgctcactgccacctgtggacactctgtgtctaccctctgagtgggaacatacttctaagttccctgcagtctctgtcctgtggtagaccatctttttgtaaactgcgagcttcctcttccctgtaccctctgccccagtcgtgaccccctaaaagttaaggggtagttggcacctccttattaatatgccagcctagatcccccccggtggaggggcaaatggctgaatccttgtgtgatatttttttcttcgcttgtttatttattcatttatttaattgtatttattcatttactaactttatgtgttaccaattaattttgtttacccattcctttatccatccctcccctccttttcaggtaaggagacaggaggagtaggaggaggcagggcctctccatgccagcctctgtggtccttgcccaaacccatcagcgcaatacttgaaccttctcccaggtaggggcaggaggagccacatgagagagggagaaggaccgcgtttacctttagagttttgttttgttttttccttctgagtttgctgttggtgcaggaataagggaaaggcccaaggtatccaagcctggggaagggcaggccagccagcacctctgccttctcagggacaagagtagtcctttaccaccctcactctgcctgtcccctctcctactctacagcattaaagactgtgggaccaggaccctaagtctcctttccttctgggtggggagttctggggttcttggtgtgtgggagaagttttataattgcttccaaacagctgggtttaaatataaaatagacacactca

SEQ ID NO: 141817 - DNA, 3718 bp, Homo sapiens; identical to SEQ ID NO: 141816
  Payload ID: 7885
  Gene Symbol: HCN3
  Gene Name: hyperpolarization activated cyclic nucleotide gated potassium channel 3
  Uniprot ID: Q9P1Z3
  ENST ID: ENST00000575670
  CDS Start-End: 9-2333

SEQ ID NO: 141818 - DNA, 7228 bp, Homo sapiens
  Payload ID: 7886
  Gene Symbol: HCN4
  Gene Name: hyperpolarization activated cyclic nucleotide gated potassium channel 4
  Uniprot ID: Q9Y3Q4
  ENST ID: ENST00000261917
  CDS Start-End: 995-4606
caaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtgaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccatccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccacaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttcacaaagaccatggggtgggtactttgattctccccatttagcagaggaagaaacagttttgggtaatttttccagaatcatgtaactaggagtggcagagtggggactgatttgaggttcgagtccacgcctccttgaggcccaagtctgtgttccttccatcagaaaactgtgttgaggggggctgaggtagatggtccccaagcatggtacagaaggaagacaccagattttggcagcagtcaggcctgggtttgaatcccagccctgccacttcttagctgtatgatcttgggcaagttatctgacctttctgtcacctcatttgtaaaatgggaataattatggtactgcctcacaaggacctatgaggaccagatgagaaaaatctatatgtgaaatgcccagcccagcgcctggcacataccatggtaggtgctcaataaaaaatcacatttcttctgcccctcatatgcccagcctattgctccagcaaactatgtgagagcccagggagctttggctgagggctccaagacttaaaatctcaggactcaggaggtggctgggcctccctaagggcccaaggaaggtgtgtggccagaggtgggtgggagccaggccttgagaagtgggaagacttcaacagggagagagggagggaatggtgggtgggatggagtgtatggtggggagattcctgaggtggatgtggagtggtggatcagggctttgggaggggatccccaggctgaggggtcagagggacggccttgggtgatagggtaagggattgtctgggcttagtcctggcaactaggagccataagcaggttccagattgcgggaacgagaaagcagctcagatgcctttggaggcaccatcctccctcctcccagatgggatcttgccagagccaaggtcaggggtctgcccctgcctatagggccagagcaggtatggctgcaatccccaagtaatgagaagggctggtcccacattatccatccagaaccttccatgctccaagccagaatgttggcaagatcgggttttgccttgagctatcctgggatgtgagacaaaccgatttctccatagatgggctgcagggagtgggaggcagtactccaggagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagca

SEQ ID NO: 141819 - DNA, 577 bp, Homo sapiens
  Payload ID: 7887
  Gene Symbol: HCRT
  Gene Name: hypocretin (orexin) neuropeptide precursor
  Uniprot ID: O43612
  ENST ID: ENST00000293330
  CDS Start-End: 88-483
cacaattgacagcctcaaggttcctggctttttgaaccaccacagacatctcctttcccggctaccccaccctgagcgccagacaccatgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcgcaggcgcagagccagcgccgcgcccctgcctcgggcgccgctgttccgccccggccgccgcctccgtcgcgcccggaggacagtccgggatctgagtcgttcttcgggccctgtcctggcccaggcctctgccctctgcccacccagcgtcagcccccagaaaaaaggcaataaagacgagtctccatt

SEQ ID NO: 141820 - DNA, 1170 bp, Homo sapiens
  Payload ID: 7888
  Gene Symbol: HCRTR1
  Gene Name: hypocretin (orexin) receptor 1
  ENST ID: ENST00000373705
  CDS Start-End: 1-1170
atggagccctcagccaccccaggggcccagatgggggtcccccctggcagcagagagccgtcccctgtgcctccagactatgaagatgagtttctccgctatctgtggcgcgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccgggcccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtgggtgtaaagagaagagtctagctctgtcctgcccatcgtgccccggccatgacccgcaccttgctgcagctctgtgtagctaa

SEQ ID NO: 141821 - DNA, 1642 bp, Homo sapiens
  Payload ID: 7888
  Gene Symbol: HCRTR1
  Gene Name: hypocretin (orexin) receptor 1
  Uniprot ID: O43613
  ENST ID: ENST00000373706
  CDS Start-End: 154-1431
cctcccttcaggaagtttgaggctgagacccgaaaagacctgggtgcaagcctccaggcaccctgaagggagtgggctgagggctggcccaagctccctcctctccctctgtagagcctaggatgcccctctgctgcagcggctcctgagctcatggagccctcagccaccccaggggcccagatgggggtcccccctggcagcagagagccgtcccctgtgcctccagactatgaagatgagtttctccgctatctgtggcgcgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccgggcccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctgagcgagggctgccctggaggctccggctcgggggatctgcccctacccctcatggaaagacagctggatgtggtgaaaggctgtggcttcagtcctgggtttctgcctgtgtgactctggataagtcacttcctctgtctgagcttgtgtcccctaagcagggttgatgtgaggattaagcatgctgaagcaagtggaaagctccttgtaaa

SEQ ID NO: 141822 - DNA, 2003 bp, Homo sapiens
  Payload ID: 7888
  Gene Symbol: HCRTR1
  Gene Name: hypocretin (orexin) receptor 1
  Uniprot ID: O43613
  ENST ID: ENST00000403528
  CDS Start-End: 388-1665
agttgccgcggatcgtgctgagccccgcgagccgaggcagcgcagcctagggagggggctgccccggccccctcctgcagtcccggcccctagaggctcggccttcctcgcaggaaggcgaagtccccggtgccaggtccggggaccagcagccgagaacgcccgggtcccggagccaacaggtgcggggtgtgggggacccccaggcctgggatcccactccctcctttccttcctcccttcaggaagtttgaggctgagacccgaaaagacctgggtgcaagcctccaggcaccctgaagggagtgggctgagggctggcccaagctccctcctctccctctgtagagcctaggatgcccctctgctgcagcggctcctgagctcatggagccctcagccaccccaggggcccagatgggggtcccccctggcagcagagagccgtcccctgtgcctccagactatgaagatgagtttctccgctatctgtggcgcgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccgggcccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctgagcgagggctgccctggaggctccggctcgggggatctgcccctacccctcatggaaagacagctggatgtggtgaaaggctgtggcttcagtcctgggtttctgcctgtgtgactctggataagtcacttcctctgtctgagcttgtgtcccctaagcagggttgatgtgaggattaagcatgctgaagcaagtggaaagctccttgtaaactgtgaagtgttgtggacatgattattgttgtacttctctcatttggccataccccacagtataatctgtccccatcctccttccagagcttggtcatcctcctaaagacccctttcctacccaatt

SEQ ID NO: 141823 - DNA, 1837 bp, Homo sapiens
  Payload ID: 7889
  Gene Symbol: HCRTR2
  Gene Name: hypocretin (orexin) receptor 2
  Uniprot ID: O43614
  ENST ID: ENST00000370862
  CDS Start-End: 337-1671
gactgagtgctggaatgaggagtaattgagcttcagctgagccggacgtagctttctcctcctggtgtcattgctgcagcctccagtgccgggtccctagttcctcagctgcctatcttcccggtgcaacatcgcctgtaaagacagcaaagccaccgcagaagttgcccggcagaagactccggaggcattggctcagtaacttttcacgtcattttctgctcgggagccccttctagcctctccgcgcagcctttcccaccgcaaatcaccagtgctcatggggcaggcggagaggagcttgcagcattgagcggaaccggacttgagcccgtgatgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctggtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtgaaatttatcccaagatgtaccacatctgtttctttctggtgacatacatggcaccactgtgtctcatggtgttggcttatctgcaaatatttcgcaaactctggtgtcgacagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatgattgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtagaatatttattcatatgacaaggatacctgagtaaaactatcctttttaaaatcactgggaacagaaattttattatcctatgatgtgaagctaaaattacttgtggatcttttttttttttaatctattgctctttggaaataaaaaaaaagtcagtttaaaatga

SEQ ID NO: 141824 - DNA, 1936 bp, Homo sapiens
  Payload ID: 7889
  Gene Symbol: HCRTR2
  Gene Name: hypocretin (orexin) receptor 2
  Uniprot ID: O43614
  ENST ID: ENST00000615358
  CDS Start-End: 464-1798
attccttttgactcactgaaacaaatcaagaggtgaatatattgaagtgagttatttttagtgaaggtggaatttgagcattcaagcttcagctctccctcagcgagggaggaggctgtgggctgcggactgagtgctggaatgaggagtaattgagcttcagctgagccggacgtagctttctcctcctggtgtcattgctgcagcctccagtgccgggtccctagttcctcagctgcctatcttcccggtgcaacatcgcctgtaaagacagcaaagccaccgcagaagttgcccggcagaagactccggaggcattggctcagtaacttttcacgtcattttctgctcgggagccccttctagcctctccgcgcagcctttcccaccgcaaatcaccagtgctcatggggcaggcggagaggagcttgcagcattgagcggaaccggacttgagcccgtgatgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctggtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtgaaatttatcccaagatgtaccacatctgtttctttctggtgacatacatggcaccactgtgtctcatggtgttggcttatctgcaaatatttcgcaaactctggtgtcgacagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatgattgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtagaatatttattcatatgacaaggatacctgagtaaaactatcctttttaaaatcactgggaacagaaattttattatcctatgatgtgaagctaaaattacttgtggatcttttttttttttaatctattgctctttgg

SEQ ID NO: 141825 - DNA, 1407 bp, Homo sapiens
  Payload ID: 7890
  Gene Symbol: HPRT1
  Gene Name: hypoxanthine phosphoribosyltransferase 1
  Uniprot ID: P00492
  ENST ID: ENST00000298556
  CDS Start-End: 160-816
ctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaa

SEQ ID NO: 141826 - DNA, 3555 bp, Homo sapiens
  Payload ID: 7891
  Gene Symbol: HIF1A
  Gene Name: hypoxia inducible factor 1, alpha subunit (basic helix-loop-helix transcription factor)
  Uniprot ID: Q16665
  ENST ID: ENST00000323441
  CDS Start-End: 29-2236
gtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 141827 - DNA, 3919 bp, Homo sapiens
  Payload ID: 7891
  Gene Symbol: HIF1A
  Gene Name: hypoxia inducible factor 1, alpha subunit (basic helix-loop-helix transcription factor)
  Uniprot ID: Q16665
  ENST ID: ENST00000337138
  CDS Start-End: 266-2746
gacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 141828 - DNA, 3922 bp, Homo sapiens
  Payload ID: 7891
  Gene Symbol: HIF1A
  Gene Name: hypoxia inducible factor 1, alpha subunit (basic helix-loop-helix transcription factor)
  ENST ID: ENST00000394997
  CDS Start-End: 266-2749
gacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaataggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 141829 - DNA, 3956 bp, Homo sapiens
  Payload ID: 7891
  Gene Symbol: HIF1A
  Gene Name: hypoxia inducible factor 1, alpha subunit (basic helix-loop-helix transcription factor)
  Uniprot ID: Q16665
  ENST ID: ENST00000539097
  CDS Start-End: 230-2782
atttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatggtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggc

SEQ ID NO: 141830 - DNA, 3468 bp, Homo sapiens
  Payload ID: 7891
  Gene Symbol: HIF1A
  Gene Name: hypoxia inducible factor 1, alpha subunit (basic helix-loop-helix transcription factor)
  ENST ID: ENST00000557538
  CDS Start-End: 479-2782
atttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatggtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaagg

SEQ ID NO: 141831 - DNA, 13011 bp, Homo sapiens
  Payload ID: 7892
  Gene Symbol: HIF1AN
  Gene Name: hypoxia inducible factor 1, alpha subunit inhibitor
  Uniprot ID: Q9NWT6
  ENST ID: ENST00000299163
  CDS Start-End: 101-1150
atggtttccgttgggtgtgtggtttttttgtttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtgattgcagtgatctctatctctccacttcttttgggaaagaggagcacaggagcggaggaaaaacttggccacagtcacacttggaaagatagtagattattttcgttctcctcagcaggtctgctgtattcctcgctcagcgctcaaagatgtgggtgatgtgtcaaggaggcatgcactcagctggtccttgctgagttatttgctgacacaggtctcactaaggtggctgaggggtgggagggagaaggctaatcttggaaccttcacaggattggccttgatccttgggtaacacaagagtgattcctgatttttagacacctaatatgtgcctagtgcttttctctttgttcctcactatcctgcaaggtaggtattctcacttacagatgaataaatgggctcagagagattaggtgattagtgacaatcagttgtaacttagcactgttaggctgcaaaccccttgctccttcctttccaccaaactatgttgattttccttccttacctccctccttgtaccacaggttctgtcctcaagatatcaccccactgggcagtatctgaaggcagacccagcccaagatggtgcagaatatacagctcagggtgaaagttcttctgggctcctgctaacaaagtcttggaaaaactgcctgggaagccatattatgaattagtgctagaagaagctgtggggggaactgagttctgtgtctaattgcattacttatgtgtccttgaataggacccataactcctcccggcatgcttttgcatctatagaactgaagctgtagttctagatggcactaagggtcttggttcatattcagctgctgcttccccccaaggaaaagatgaggtttttccccttcgattaccttttgagggatgtttaggctcaaattctgcttgccacagaggaaacatttctgctgtagttgtttacctccatcctagctggcagtgtgggacacacacatacagcaagtgaaggtgggggtttgggcctgtatagaggtcagctacgctgcaggctcatctattcacaccagcaggtacagagaaaactagtgttttgtaaagtcaaatatttgttgggggttggagttctggggttggaggaggggctgttctgggcatcagttgagcagatgcccaggatgcctgggggagaccagcttcccctacaaatcagagctctaaattacaaggtttttaccaacgtgaacagttgggggaagtcgtctgctctcatttgcgtaatggtttctgtcactggtgattagacacaggatgaaggaaaagaaatttgacaattaggaatgagcgatcattaatctgaatctgttaggagacagagaggggaaggatccttatcagtgggccagcccagtatggggagacactccctccctctgcccccagagactcctgggctacatcctctttcagtattgccacaagtgggcagagcttgtatttcttaacaaagattagggacccagttgccagcctgagatggatataggaacagacatctttgggcatgagccaacaaagatagaaatagatgagtgtcaggtacaagctataaggcaaagaataacagtggaaaagttttgacatgtgtttgccatttgtggaaaatgtttttgtaatagtcaacacccctcatagcccacctgtgacaagtacttgttacattccagcactgtagggcgtgaggaaaatctggtccttatcaaatcccaggagcttctgcttagttggggaagaaattacatgaagcaaccagaggttataaggccacacttgtatatcgtgcaccctgtgtggacaagattagggactgttgagagaggaggaaaccagtagagagcaaagctctacccaggctccttgtaagcctctgggctcccccgagagggcctcgctactctacgcttcctagcaacgttgatgtccccacaaccccacatcagtgcagctgtggctgtgtggaggggctctgaggcctctgaggccagatgtgtaaacagtgctgaggttcagtaataggatgagtcttcaggtgtggagcagcccaccttggctcttcccatgtctctgtgttacttctcatattctgctgtcctttcaaacttcaaggacagtattaatttatactagtatttcttcctcagttttgtgacttgaatgcagtgagtgccttagaggatccaaggatgaaggaatgcgggttggtggttctctctttcagaatgggaacttcccaaaaatggggctgcgtctcgcctctcagtaggttccctacctctgggtcttccacccttcaaaatctggtacagaatttagcaggggctgcagggaatgaccctcagggaccagtttcacccagatggggtagatgatgaggtatacctagaagtagctcagggctccagagtctggcctttcagctggtgtcttactcccctttgagaccttcagctgcttgtcttccactgcctgcatacttctctgatgtcttctcaaactgttggctctaaagggatgttccagcctccctctccagagctgcctgcagtttcccttattcagctgtctcctgcctagtctctccagcggcctccttaccaagaccctttttcctaaacagttgtccttccctcagaaactccatggctgcaagtgtgaatagacttgtctttaggatccctctctctggtcatccctgatcatcttagggccgtctcccttttctgatttttgacagctctgtttattttgcccatggctagtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttattatgtgatttattcagaaacttggtttcagtgatctctaaacagatttccagtggttctttctctctcaagaaaagcatagggaaaaacgagaaacaccttagataaaccatattgagttgagggtagacagaagagtctagtacctaaactcaccctagaggaagagaaacaggaagtgtcttatgcctcttctgcctgggcagccagactttactgctgtactaccagcccagggccttgggtgagaaggtttcaggtctgagctccccttgcactgtgtgagaggccgtggagccgaatgagtccttattatacctggagaagctgttgtctcctcacaccatgaaatgtaatagcagtcaaatcaggcccctcttgattcaattttagtccatgcctttccatgtatttaaattatataagtgttggccaggtgtggtggctcacacctgtaatcccagcacttcgggaggctgaggcaggaggatcacttgagcccaggagttcgaaccaaccttgggcagcatagtgagaccccttctcttaataattttttttgaaaataattttttaaaaattacaaatatggaccagacacctgggaggattacctcacgcctgtaatcccagcactttgggaggctgaggtgggtggatcacctgaggtcaggagtttgagactatcctggccaacatggtgaaaccctgtctctactaaaaatacaaaaattagccagatgtggtggtgggtacctgtaatcccagctactcgggaggctgagacaggagaatcacttgaacctgggaggcggaggttgcagtgagctgagatcacgtcattgcactccagcctgggtgactacagtgagactccctctcaaaaaaaaaaaaaaaaaattatgagtatgttaagattgttctaggggagaagggcaatcaaaattcagaaaaatatgagtgggatgttaatagctaccatttgttgaacacttctgttccaggcactgtattagttcgtccccatgtggtgctctcagatcagtaggggagacaggcaggcagttagaattatggtgtatagaggagaagcattgcactatgtccagttttttatggtaggcttcctgcagaaagtgataagtccaagctgatatgtggaagatgaataattaaccagaggttgggggatttcccccttagcttctctttcttccagtccagcagtccaaaacaaacactgcttcccaatgcctaagggttttgtcgtaccttactccagggaatgggtgagacagtagatcccaagaagaaaaccctttggttagtcacagaaatctgaaagtcttggttgctggctcagatttgtcctggagtggacgtagattggacttgcttatttgtagccctccaccgttctcatttgtgttctggcctctggagccaccctgccagaccctacttggaagaaatgttgaatcaagctactcagacttcagcctgagatgtattatggctggctggaattctcagccctttccacatcatgatcccattaatctcttgggtctatccccacgcccagccacctctcctcctcactataagccaagtctccctgcagttctctataaatactcagatcctcttgcctcagaccctggtccctagctttgtgggtgaagaagatacctctttagcttgtgccaacccatccctctgggctacaggccattctgtagtcaccttgcagtcacgtctttccttctagataactggctctgggccttggaaaccttctctttggctctagctaattttgctgttttattccgtttacttaaaacctattcacttggtcattgaggtcagaactatcaggaaagctgtgctccttaacccatcatctaagctaagcttgggccaggtttttattacctcttgaatatatatagtgcaatatagtgtagtggttgagagtggagtctgcatacctggatctgccattctgcatgactttgggcaaatggacaaactgcccgaaacttgacttgtttatatgtatggggaagacatcatttacattgtcagggtaaggcttagcagaatgaccggtccatagcaagggctcagtctttctgtgtctctcagtctttacctctcttccccatctagctttctgtctaagttcctgtttctagtctcagggcatatctagttgtcagctcctgagcagagcagaggtataagtgtcaactcatgcttgtgttaccagttcctacccctgtcagtaacctctgatgcttacaaggatactatcacctatgccatcagtggggaatgaccttccaaaaatatttttaacaatactaaaaatacctgaaacatactgggtgaaaataagacattggagctgctgctccccaaggagataaaaggacagttcctaaagaggcattgaaggtttgtatgagccagcagcacagtcagaaggcaagaaggagaccctgggatgtgcacaaggatgcaggagacgagattgtcacagaggctgtcatgctagtaagagtcagaggttactgatgggtagagattgtcagagtctgccttgctagtctagaggtaggaccatggatttaagaacgttgcctccaagtttttgaattgtgaatttttgatcatatttgaacaaaaccccacctacagtctgcatggtcattgttctcacaagggtttgtgtgatgcactgacaagaacagaggctttggaggtgactcctgggtttgaatcaccatttgccactagctaattctaaccttaggtaagtcagtgtctctgggtctcaacctcttcctctgtgaggggtaggaaatagcacataacttgtagcattgttataagggctcgtgataatgtttttaaaacacctggctcaagcactcaggaaaatgttttattatgaagaccaagtgtctctgaaaagtgtttccttagtgtctggagagactacagcagcaaggcttttctgatcctactctgactctcaagataatggtgcttgaagtgaaatcacagaagagatgactggggcaggaaaagcaagatggaaaagataaagttgtggaagggactgaaagtccatgaagtgctgggctggggacagaaagggtttaatagggcagggtcttgaggaacaggaacagagaccttggttctgggttgccatctgattcccagaagagtaaaggaaatggggcaggaggatgtctgtggaggacacagtgtggctgagtggagagaacacaagcttctggccagtgaacctaagtgagaatgtcagtggactttgcacaggctgggtgcctttgggggtgttcatctcgctatgcttcggtcccctcatttaaaaaaattggttaataatatgatgacctgccaatgtgtgtggaaatactatgtaaactgagcactatataaatgctggttgttgagatattgggagtgggggtttcgggagattttgtttgtttgtttttttgagatggagttttcgctcttgttgcccaggctggagtgcagtggcgtgatcttggctcactgcaacctccacctcctccaggttcaagcaattctgcctcagcctcccgagtagctgggactcaggcgtgcgccaccatgcctggctaattttgtatttttagtagagatggggtttctccatgttggtcaggctggtctcgaactcccgacctcaggtgatctgcctgccttggcctcccaaagtgctgggattacaggtgcgagctaccacacctggccctggatttcttaataggtcctcttatgtggctattgagaatgaatgagacaactcattaactaactaagttaattcagaacttagtgcctagtaagtgctcagtaaatgttagtttcttttcctccatttcttcttaggaagcatcgtttacccagcataaacaggaggactcaactgtgcatgtcttagtgtgaacaagtaacatcagatttcccttttctgaggagagatcagttctgtaagagggagcatgagtgtgaatggggaagaatcatggagaagggagcaggactccacagtactggagatggagtagggacctctgggaatcgttggcatgggggtgtggtgcagaaagggtgatgctaagaggtgagagtctcaagaaagaagatgggtgttctagaggggaaagctaaacgatgataggcaatgaggagcggaggacaagaccctgaactaagggtgaggaggccagcattctgtcaggagaaccttaggaattgtgaccagaagtcaaagttgttacagcaatcctgcattcaaccaggtttcatctgaaaaacttaagagttgctaggcacagtcgtgcacacttgtaatcccaacactttgggaggcttgagtcaggaggaagcttgaggccaggagtttgagatcagcctaggcagcatagtgacaccccatctcttgaaaaaacaaacactcttaagagcagtggttcacctagaaataaaaagcagaaatcatcaagatgagaagacattttgtgttttgacagccaaggaaatttgccactgagacaaggtatctgacagcctagatgggattctagacttctgtgagaaagtgcagttaggccctgaatagcgtcaaactcagggatgtgagctgactgactgcctttttatgtaatggaggccatgtgatagggctttatgaggccacaaatagcactttctgggtcctttcacagtctagtcagtggcccaaccaacatatctggttgttctgcaatctcagtcatctgagaagataacctccaaaatacatgcagtggcatcaggtgtttccttggtaggtgtgcatcttttaatgatggaggacttaggatgaagaacaggtgtgtttaaaaacatcaaacccccacatcattactatttgctgtaaggatctatgcagtttgtattttaagtccttgacatatggaagagcatttgtgagagtaacaggtttgctttgtaatgccaactaaaaagtgtgtatttatactcgaattttaagttgaaattttgctaagtttcttttttttttttttgagacggagtctcactctgttgcccaggctggagtacagtggtacaatcattgctaagtctttctgtagttttagaacatttagaacaacttaagatttcctgtatttataaacttaatttattggaaatataagtacttgatcaggttttgtcttggtcagataaattaagtacttaaggaaatcaaatacattaatcatataaatgccatttaagtgtttaaaggagtttagttaaatgtaagttggatcaaacattaaacttttttgttttataagcaaaataataagatttgttagcagaacttaaaagcttagaaaagagaggattttggatatgtaactttgaagaggtgaatagtttgctcttttctgagacagggcattgcttttcgacgcaggctggagtgcagtggggcaagcatggctcactgcagcctcaacctcctggactcaagtgatcctcctgcctcagcctcccatgtagctgggatcacaggcacatgccaccacacctggctaattttttattttttgtagagacaggggcctcacttcattgcccaggcggatctcgaacacctgggctcaagcagtcctgcctcagcctcccaaagttctgggattacaggcataagccactgtgcctggccttgaatatattttttaaccaaagtaatttatgaatataaattgtttctatataacccaaagtcactctcattgacattaagaaactcagagagtgggttctaaatgtaatattaccacacacccaagtcacttagcctctacaagtaccacgtaactagcagccgttaaaagatggccaccgctagtccagtcggccacagacatggttttgtttggccaatacaagtttttgaaagttttaaaaaattgacaacattaaagatcagaaacttgacctaaaaa

SEQ ID NO: 141832 - DNA, 708 bp, Homo sapiens
  Payload ID: 7892
  Gene Symbol: HIF1AN
  Gene Name: hypoxia inducible factor 1, alpha subunit inhibitor
  ENST ID: ENST00000526476
  CDS Start-End: 45-152
ggcggagcttccggttccggtgggggccgtccctggcggcggagatggcggcgacagcggcggaggctgtggcctctggctctggagagccccgggaggaggctggagccctcggccccgcctgggatgaatcccagagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacga

SEQ ID NO: 141833 - DNA, 1042 bp, Homo sapiens
  Payload ID: 7892
  Gene Symbol: HIF1AN
  Gene Name: hypoxia inducible factor 1, alpha subunit inhibitor
  ENST ID: ENST00000533589
  CDS Start-End: 470-1042
aaatgaaactcgacgctctggatagagccaaggaaggctcctgctattcgggggtcctcgagggagccattaaaacctcggcttcctcatttgaggaaacagcctgagccaaggagaaaattgaagtcctctcagctgcagctgctcacccacccccctcccacctccctccacagagaaaagcacccactccattgactctgaggggtcacgagaaggttcgggaaaaagggtcacagtcaagccacccaacccagccggccttctcccatcactacttgggtgcgagcataccctctctgtctcaccccatgccatcatccgggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataag

SEQ ID NO: 141834 - DNA, 2250 bp, Homo sapiens
  Payload ID: 7893
  Gene Symbol: HIF3A
  Gene Name: hypoxia inducible factor 3, alpha subunit
  Uniprot ID: Q9Y2N7
  ENST ID: ENST00000244303
  CDS Start-End: 161-1963
ctttcctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcatt

SEQ ID NO: 141835 - DNA, 2551 bp, Homo sapiens
  Payload ID: 7893
  Gene Symbol: HIF3A
  Gene Name: hypoxia inducible factor 3, alpha subunit
  Uniprot ID: Q9Y2N7
  ENST ID: ENST00000300862
  CDS Start-End: 70-2073
agataagtcagggaggggacagagcggccctaggcgcgccacagagaggagcgaggcgccagaggcaccatggactggcaagaccacaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatga

SEQ ID NO: 141836 - DNA, 5852 bp, Homo sapiens
  Payload ID: 7893
  Gene Symbol: HIF3A
  Gene Name: hypoxia inducible factor 3, alpha subunit
  Uniprot ID: Q9Y2N7
  ENST ID: ENST00000377670
  CDS Start-End: 32-2041
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatgatgaattgcctggggtctgtaagaatgtgggactctgatcttccccctcttcaggtgtcagtgcggagaggctctgggccagacctcacccccagtgacttccgattgaggccaaagaccccaagctgcccgccagctctgactgccccttgcgctctgggcttcctgccgcccccagctttgcctggacactgacttcattcatggtcctcctacttcaggggcagcctcccagttcctctgcttccaaactatgcaacctccaacctgctccagttccagactgtataacctctgacctgcactggttctagaccacacaacctccaatgtggtctgctttagatcaccttcttcttcttccttcttcctcttcctcttcctcctgctcctcttcctcttcttcttcttttttttttttgacagagtcttgctctgtcacccaggctggagtgcagtggcgcgatttcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctctttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctagttctcctagattctgaacctcatgacctgtaccactcactagttccagactacacaacttctagaaggtgccacctccagggtcctgattcaagatctggtgatctgctgtttctctggttctagaactgacttacaagtgccttctgattctagacctcattccgtaagttcccttggctctagacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctaaacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 141837 - DNA, 539 bp, Homo sapiens
  Payload ID: 7893
  Gene Symbol: HIF3A
  Gene Name: hypoxia inducible factor 3, alpha subunit
  ENST ID: ENST00000526506
  CDS Start-End: 118-327
actcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagagtcccaattgttgggatggagctggggaggcctga

SEQ ID NO: 141838 - DNA, 562 bp, Homo sapiens
  Payload ID: 7893
  Gene Symbol: HIF3A
  Gene Name: hypoxia inducible factor 3, alpha subunit
  ENST ID: ENST00000533789
  CDS Start-End: 32-277
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccat

SEQ ID NO: 141839 - DNA, 1709 bp, Homo sapiens
  Payload ID: 7893
  Gene Symbol: HIF3A
  Gene Name: hypoxia inducible factor 3, alpha subunit
  ENST ID: ENST00000472815
  CDS Start-End: 125-1477
actcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 141840 - DNA, 544 bp, Homo sapiens
  Payload ID: 7893
  Gene Symbol: HIF3A
  Gene Name: hypoxia inducible factor 3, alpha subunit
  ENST ID: ENST00000531043
  CDS Start-End: 1-281
actcagagcccccgctgcagtgcctggtgctcatctgcgaagccatcccccacccaggcagcctggagcccccactgggccgaggggccttcctcagccgccacagcctggacatgaagttcacctactgtgacgacaggaatggtgactctggattcagcctgcttgagtgtcagtcttggctgtgtatccttagccaaatgacttcacctctctgtgccacaatttcctcacctatactgtggaatcataacagaacctgccttgtacagtcgttctgagcagctcagattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcag

SEQ ID NO: 141841 - DNA, 573 bp, Homo sapiens
  Payload ID: 7893
  Gene Symbol: HIF3A
  Gene Name: hypoxia inducible factor 3, alpha subunit
  ENST ID: ENST00000533145
  CDS Start-End: 129-573
acccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggccactaggatgtacccccacttccttgggggtgcatgggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtgg

SEQ ID NO: 141842 - DNA, 1486 bp, Homo sapiens
  Payload ID: 7893
  Gene Symbol: HIF3A
  Gene Name: hypoxia inducible factor 3, alpha subunit
  ENST ID: ENST00000528563
  CDS Start-End: 157-366
cctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctcc

SEQ ID NO: 141843 - DNA, 576 bp, Homo sapiens
  Payload ID: 7893
  Gene Symbol: HIF3A
  Gene Name: hypoxia inducible factor 3, alpha subunit
  ENST ID: ENST00000600879
  CDS Start-End: 85-294
cttttctctttcccgagtcaccaccagtgaatgctgcccatgccctcaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggcca

SEQ ID NO: 141844 - DNA, 2101 bp, Homo sapiens
  Payload ID: 7893
  Gene Symbol: HIF3A
  Gene Name: hypoxia inducible factor 3, alpha subunit
  ENST ID: ENST00000600383
  CDS Start-End: 85-1869
cttttctctttcccgagtcaccaccagtgaatgctgcccatgccctcaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 141845 - DNA, 1349 bp, Homo sapiens
  Payload ID: 7894
  Gene Symbol: HILPDA
  Gene Name: hypoxia inducible lipid droplet-associated
  Uniprot ID: Q9Y5L2
  ENST ID: ENST00000257696
  CDS Start-End: 202-393
gacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttc

SEQ ID NO: 141846 - DNA, 785 bp, Homo sapiens
  Payload ID: 7894
  Gene Symbol: HILPDA
  Gene Name: hypoxia inducible lipid droplet-associated
  Uniprot ID: Q9Y5L2
  ENST ID: ENST00000435296
  CDS Start-End: 130-321
aaggggcggaggctgggcggcgttgctctgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaa

SEQ ID NO: 141847 - DNA, 2023 bp, Homo sapiens
  Payload ID: 7895
  Gene Symbol: HYOU1
  Gene Name: hypoxia up-regulated 1
  ENST ID: ENST00000530473
  CDS Start-End: 54-2023
cgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaa

SEQ ID NO: 141848 - DNA, 2464 bp, Homo sapiens
  Payload ID: 7895
  Gene Symbol: HYOU1
  Gene Name: hypoxia up-regulated 1
  ENST ID: ENST00000543287
  CDS Start-End: 128-244
gtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccagatgctcttcctttgtccagctagattgccacagtccaagcaggccattgaccgtttccatacagcagtcacctgtatggaacccccatggggtcggcggtgccgagccaggcctgcctggaggctctgctcctgatcgttccctggggcgcctgtggtgtttcccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgta

SEQ ID NO: 141849 - DNA, 711 bp, Homo sapiens
  Payload ID: 7895
  Gene Symbol: HYOU1
  Gene Name: hypoxia up-regulated 1
  ENST ID: ENST00000534233
  CDS Start-End: 39-711
gcgcgggtggggggcgctgccggcctcgtgggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactg

SEQ ID NO: 141850 - DNA, 862 bp, Homo sapiens
  Payload ID: 7895
  Gene Symbol: HYOU1
  Gene Name: hypoxia up-regulated 1
  ENST ID: ENST00000526656
  CDS Start-End: 228-862
aagaggtagcgggggtggatggaggtgcgggccggccacccctcctaggggagacagcgtgcgagctccgggggcgggtcgggagcgcaagggagggccgcgcggacgccgggcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcag

SEQ ID NO: 141851 - DNA, 582 bp, Homo sapiens
  Payload ID: 7895
  Gene Symbol: HYOU1
  Gene Name: hypoxia up-regulated 1
  ENST ID: ENST00000532421
  CDS Start-End: 119-582
aacagtttgcaaaccgagaggagttgtgaagggcgcgggtggggggcgctgccggcctcgtgggtacgttcgtgccgcgtctgtcccagagctggggccgcaggagcggaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaa

SEQ ID NO: 141852 - DNA, 629 bp, Homo sapiens
  Payload ID: 7895
  Gene Symbol: HYOU1
  Gene Name: hypoxia up-regulated 1
  ENST ID: ENST00000527038
  CDS Start-End: 183-629
ggtgcgcgagacgccgccgagaggttggtggctaatgtaacagtttgcaaaccgagaggagttgtgaagggcgcgggtggggggcgctgccggcctcgtgggtacgttcgtgccgcgtctgtcccagagctggggccgcaggagcggaggcaagaggtagcgggggtggatggaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtg

SEQ ID NO: 141853 - DNA, 550 bp, Homo sapiens
  Payload ID: 7895
  Gene Symbol: HYOU1
  Gene Name: hypoxia up-regulated 1
  ENST ID: ENST00000531968
  CDS Start-End: 58-174
gagcgcgcgccgcgtccggggccggctggtgcgcgagacgccgccgagaggggcactatggcagacaaagttaggaggcagaggccgaggaggcgagtctgttgggccttggtggctgtgctcttggcagacctgttggcactgagtgggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctgg

SEQ ID NO: 141854 - DNA, 2162 bp, Homo sapiens
  Payload ID: 7895
  Gene Symbol: HYOU1
  Gene Name: hypoxia up-regulated 1
  ENST ID: ENST00000532519
  CDS Start-End: 126-2162
aacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaagcctgttgtctgcagagcctcagttaccaggtttggtttctga

SEQ ID NO: 141855 - DNA, 552 bp, Homo sapiens
  Payload ID: 7895
  Gene Symbol: HYOU1
  Gene Name: hypoxia up-regulated 1
  ENST ID: ENST00000530467
  CDS Start-End: 245-552
gcaaaccgagaggagttgtgaagggcgcgggtggggggcgctgccggcctcgtgggtacgttcgtgccgcgtctgtcccagagctggggccgcaggagcggaggcaagagggatgtggcaaagccgaggacccatgctctttcacttgggcctttgtgtgggcgctgctgggatgattagagaatggtttgtacccatcaggagggagaaggggagaagtaggctgatctgccctgggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacct

SEQ ID NO: 141856 - DNA, 4529 bp, Homo sapiens
  Payload ID: 7895
  Gene Symbol: HYOU1
  Gene Name: hypoxia up-regulated 1
  Uniprot ID: Q9Y4L1
  ENST ID: ENST00000617285
  CDS Start-End: 126-3125
aacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctac

SEQ ID NO: 141857 - DNA, 3057 bp, Homo sapiens
  Payload ID: 7895
  Gene Symbol: HYOU1
  Gene Name: hypoxia up-regulated 1
  ENST ID: ENST00000614711
  CDS Start-End: 101-2134
gtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttct

SEQ ID NO: 141858 - DNA, 1569 bp, Homo sapiens
  Payload ID: 7895
  Gene Symbol: HYOU1
  Gene Name: hypoxia up-regulated 1
  ENST ID: ENST00000614668
  CDS Start-End: 50-493
gccgcgtccggggccggctggtgcgcgagacgccgccgagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacccctgtgatttggaggtgtggagaaggggaagggagggacagctcactgtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttct

SEQ ID NO: 141859 - DNA, 4360 bp, Homo sapiens
  Payload ID: 7895
  Gene Symbol: HYOU1
  Gene Name: hypoxia up-regulated 1
  ENST ID: ENST00000612687
  CDS Start-End: 146-2959
gagaggttggtggctaatgtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttc

SEQ ID NO: 141860 - DNA, 3358 bp, Homo sapiens
  Payload ID: 7895
  Gene Symbol: HYOU1
  Gene Name: hypoxia up-regulated 1
  ENST ID: ENST00000621959
  CDS Start-End: 263-3076
agtttgcaaaccgagaggagttgtgaagggcgcgggtggggggcgctgccggcctcgtgggtacgttcgtgccgcgtctgtcccagagctggggccgcaggagcggaggcaagagcttctctgtttagggatgtggcaaagccgaggacccatgctctttcacttgggcctttgtgtgggcgctgctgggatgattagagaatggtttgtacccatcaggagggagaaggggagaagtaggctgatctgccctgggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcattcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctg

SEQ ID NO: 141861 - DNA, 491 bp, Homo sapiens
  Payload ID: 7895
  Gene Symbol: HYOU1
  Gene Name: hypoxia up-regulated 1
  ENST ID: ENST00000610597
  CDS Start-End: 216-491
aatgtaacagtttgcaaaccgagaggagttgtgaagggcgcgggtggggggcgctgccggcctcgtggcttctctgtttagggatgtggcaaagccgaggacccatgctctttcacttgggcctttgtgtgggcgctgctgggatgattagagaatggtttgtacccatcaggagggagaaggggagaagtaggctgatctgccctgggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaat

SEQ ID NO: 141862 - DNA, 4360 bp, Homo sapiens; identical to SEQ ID NO: 141859
  Payload ID: 7895
  Gene Symbol: HYOU1
  Gene Name: Hypoxia up-regulated 1
  ENST ID: ENST00000627731
  CDS Start-End: 146-2959

SEQ ID NO: 141863 - DNA, 2464 bp, Homo sapiens; identical to SEQ ID NO: 141848
  Payload ID: 7895
  Gene Symbol: HYOU1
  Gene Name: Hypoxia up-regulated 1
  ENST ID: ENST00000625612
  CDS Start-End: 128-244

SEQ ID NO: 141864 - DNA, 711 bp, Homo sapiens; identical to SEQ ID NO: 141849
  Payload ID: 7895
  Gene Symbol: HYOU1
  Gene Name: Hypoxia up-regulated 1
  ENST ID: ENST00000628974
  CDS Start-End: 39-711

SEQ ID NO: 141865 - DNA, 862 bp, Homo sapiens; identical to SEQ ID NO: 141850
  Payload ID: 7895
  Gene Symbol: HYOU1
  Gene Name: Hypoxia up-regulated 1
  ENST ID: ENST00000627494
  CDS Start-End: 228-862

SEQ ID NO: 141866 - DNA, 550 bp, Homo sapiens; identical to SEQ ID NO: 141853
  Payload ID: 7895
  Gene Symbol: HYOU1
  Gene Name: Hypoxia up-regulated 1
  ENST ID: ENST00000626576
  CDS Start-End: 58-174

SEQ ID NO: 141867 - DNA, 1569 bp, Homo sapiens; identical to SEQ ID NO: 141858
  Payload ID: 7895
  Gene Symbol: HYOU1
  Gene Name: Hypoxia up-regulated 1
  ENST ID: ENST00000629227
  CDS Start-End: 50-493

SEQ ID NO: 141868 - DNA, 491 bp, Homo sapiens; identical to SEQ ID NO: 141861
  Payload ID: 7895
  Gene Symbol: HYOU1
  Gene Name: Hypoxia up-regulated 1
  ENST ID: ENST00000626494
  CDS Start-End: 216-491

SEQ ID NO: 141869 - DNA, 552 bp, Homo sapiens; identical to SEQ ID NO: 141855
  Payload ID: 7895
  Gene Symbol: HYOU1
  Gene Name: Hypoxia up-regulated 1
  ENST ID: ENST00000629044
  CDS Start-End: 245-552

SEQ ID NO: 141870 - DNA, 3057 bp, Homo sapiens; identical to SEQ ID NO: 141857
  Payload ID: 7895
  Gene Symbol: HYOU1
  Gene Name: Hypoxia up-regulated 1
  ENST ID: ENST00000628429
  CDS Start-End: 101-2134

SEQ ID NO: 141871 - DNA, 582 bp, Homo sapiens; identical to SEQ ID NO: 141851
  Payload ID: 7895
  Gene Symbol: HYOU1
  Gene Name: Hypoxia up-regulated 1
  ENST ID: ENST00000628600
  CDS Start-End: 119-582

SEQ ID NO: 141872 - DNA, 4529 bp, Homo sapiens; identical to SEQ ID NO: 141856
  Payload ID: 7895
  Gene Symbol: HYOU1
  Gene Name: Hypoxia up-regulated 1
  ENST ID: ENST00000630669
  CDS Start-End: 126-3125

SEQ ID NO: 141873 - DNA, 3358 bp, Homo sapiens; identical to SEQ ID NO: 141860
  Payload ID: 7895
  Gene Symbol: HYOU1
  Gene Name: Hypoxia up-regulated 1
  ENST ID: ENST00000629353
  CDS Start-End: 263-3076

SEQ ID NO: 141874 - DNA, 2162 bp, Homo sapiens; identical to SEQ ID NO: 141854
  Payload ID: 7895
  Gene Symbol: HYOU1
  Gene Name: Hypoxia up-regulated 1
  ENST ID: ENST00000629679
  CDS Start-End: 126-2162

SEQ ID NO: 141875 - DNA, 629 bp, Homo sapiens; identical to SEQ ID NO: 141852
  Payload ID: 7895
  Gene Symbol: HYOU1
  Gene Name: Hypoxia up-regulated 1
  ENST ID: ENST00000628120
  CDS Start-End: 183-629

SEQ ID NO: 141876 - DNA, 2023 bp, Homo sapiens; identical to SEQ ID NO: 141847
  Payload ID: 7895
  Gene Symbol: HYOU1
  Gene Name: Hypoxia up-regulated 1
  ENST ID: ENST00000630070
  CDS Start-End: 54-2023

SEQ ID NO: 141877 - DNA, 7817 bp, Homo sapiens
  Payload ID: 7896
  Gene Symbol: IBA57
  Gene Name: IBA57 homolog, iron-sulfur cluster assembly
  Uniprot ID: Q5T440
  ENST ID: ENST00000366711
  CDS Start-End: 3-1073
agatggcgaccgcggcgctgcttcgaggcgccactccggggcgcggcggcccggtctggcgctggcggctgcgcgcggccccaaggtgccgcctggcccacagctcctgcagtcctggtggcgacccaacggccggagcggcctgggcctgcttccggctggacgggcgcaccctgctgcgcgtgcgtggccccgacgcggcgcccttcctgctagggctgctgaccaatgaactgccgcttccgagtcctgcggccgcgggggccccgcctgctgcgcgcgcgggctacgcccacttcctgaacgtgcagggccggacgctctatgacgtcatcttgtacgggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggggccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggtgcccaggtggccttagccgcatctgtgccagactggtggcctacagtctccaagtagtccgaagccttggctggcgcaggctgatggggaggctggggcctggggcctttggcctctgtccagggtcttcccgtcccatctgtctgctgcgcctactgggtgggagccctggtttccatctgggaaagtcccccttgtaggtgccctgcctggccccacccatgctcaggggccccaggcacgtgggttgttttctccctggacttcctgtggccccagaggagcccaccgtgtgagtgctgggctccagatggcgccgggtcccaatcgtggctccacacagggttgtctgggaggacgggacggtgtctctggccagcactggcagcttccgggccttgtaccccactctgcctggcatgagcctcatggggggttggtccctgtgcctggaagcggggtggtgtccagggtctgcaggctggggctcgggctttgggagttgtttcactgtgcttgcttccagcatgtctcagggtggggctatgcgtggtctagaggggtctggggcattggatcaggtggcatgtgggtgtctacacatcgagaagcacacagggatgagccactaggtatcccatgctggaggcttgtggaaggctgtgcccatctcccatgtttccccacctctgttcctcctcagagccctccaggagcgtggggtgggggccagcgcagggctcaggagccagcagggcagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcagccccttgggagctctggtttcatttgggggagagggaggtgggggcttagtttttgtgatctggctgactggaccccgggaacagcgctcctttgagaacgcccagacctaccagatgaagcacttggcatggctgcaggccagcaggggaggcctcagaggcccaggctgggcacgtgggtgccgagtctgcaaaggacagccccatggctgtgagctgtcggctgcagggcgcagggcctggggggcaggcgtttgggccaccaagctggacgttagggtggccacagagggccaagcaggcagggagcctgtgccgccatcctggggggccacaggtgctctctagaaatctgcagccatggcggttttggggtcaggggtctaaaggcagctctgagctgcagtgtagtttgtgatcacccaggaggagggtgtagagcggatggacgggaggaagcggctgcagctggagggaagagaggggccgtccagcctcacccgctgcagtcagctctcctatgggcaaggaaacagctaggtggccctgacccctgcggtcctgagagccggtggccttcagcccctcttggacaggtcatggtctggaagcgcccagcgcaggatggattccagaccagcatccctgcaaccttttcagccccactggctgctgctttaaactggcatggagacatttgatcagcttcccagccagttttctctccagctcagccaggagtgggtgcctgtggcctgtgtcaccaagagctggtgtctcctgcatgaggggcatgcacccctggaatgagggtctgtgcctcgagctcaaagtgtcccggctctgtcatctgcctgaagttgcctggcttttccagtggggcctccttgagtgctgcagcatctgggagcatcctagcctgtcccgtgggtgtggctgggtgagggctaggaggtgagccaggaaggaagcactccactccagagtgaggtgccgcctgagccatcctgtgccccctcagtgtcttcaggtctctgcaggtgtcaggatctcaaaatacttggttcagatcaaacacatttcgtgttcttctgtgtccttttttttttttttttttttttttgagatggagtcttgctctgttggccaggctggagctcagtggcacaatctctgctcactgcaacctctgcctcccaggttccagtgattttcctgcctcagcctcctgggtagctgggactacaggcacatgccccatgcccggctaatttttgtatttttagtagagatggggttttaccatgttggccaggatggtctcaattacaggcatgagccactgtgcccagcctcttctgtgtctttaaaaaggaaagtgtcagtcaacaaaagagcccctctgtcatacaaaccaaatcagttttcaccaaaatgtccttagtcctctcagaaaggcctggcctttaggaccttggaagcaggccctaaagcgcatcggcagggtcagagctttgtgttcaggaacactgggatctgctgagagctggtgtagccgctccaaaactgcacactgcttttcctgtctgctttagtttgtgttgtaaaaacataggaagttcgtgtgtgtgtgtgtgtgtgtgaattcaaggcataaggtgcagttgtgttatgtgggtatagtgcatggtggtgcagtctgggcttcttaccctcacacctcctgcctcccctcgttagagtcccccacatccgccttccactttctgagcccacattgcctgttgggcagctcctggttatgaggcaggacgtgtggtgtttgactgtctgtttctgagctgttttacttaacacagtgtatatggtgcatctttaggaaagcatgcttgtattttcctttcaaagccagatatgggcgggtgtggtggctcatgcctgtgatcccagcactttgggaggccgaggcaggaggattgcttgagcccaggagtttgagagcagcctgggcaacatatcaagactctgtctcttaaaaaaaaaaaaattagccaggcatggtggtccacacctgtggtcccacctattcgggaggctgaagtgcgaggatcacttgagcccaggaggttgaggctgcagtgagctgtgattgtgccactgcactccagcctgggcaacagagcaagaccctgtcttaaaacaaagaaagaataaaaaagaagagaagttgcagttggtagtatttccagagcccggcagacagtgtagaaactgtgagaaacccacctccaaatcaggccttagatagaaaacatcctaagaagtatacgttcattgtaaaatcattatcatcatcatcttctaatccccaaggagacaagctccctgttctgtgttcttgtatgaggcggtcagtcaagcgcagcccgagaggagaggcaggagcctgggagagcctctgctagacctttcctggcacttccccaggaaaggcaaggcagggcagatgtgcggctggccagctggagtgatttccatgggctccaagctgtaggagtggtccctggctgccagagtgctctggccagatagaggtgggctctggactggtgaggctgcattgcggaggcgcgcacacccagctgggcccttatctgtaaggactggctggcctgggaggggcagtctcccagccagaaggtggaatttttttttttttttgagataccaaaacatcctaaggtacaggaaagaaattgtcaacacacacacacagtaccataaacaaggcccagcagaaaggcagacagaagcacacacaccaatgttctgatcttagagtaagcagacacatcacatggaatgaggatgtttaatatatttaaagaaaacaatttatgcacaggaagcaagagactataaaaatgaccaagcagattttaaaaagagaacttgttgaaataaaaataaaatactctaaaaaatattccatgatgtgtttcctgaagaatcgggaactgtttgaagaaatgacccaaagtgcagcacagaaagacagagctggaaaatatgagatgggatgagacaagaagatggagagtttagtatgacatccgcaatttacgagtaattccagaaggaggggaaagagaatatggggtggaggcaagtattcagagaaatacggctgagaactttcccaaaccaacaggagcccctgctccttaggttcaggaaccagcagctcccaagcagcatagttaaaaagctctacccaaacagtcacgtcttggtgaaagtacagaatctcatgacaaagagatcttaaggcagaaaagaaagagattatctggaaagaagaaaataagtagttgattaaaagcaacagtggaagccagaaagatagtaaataatatcttcaaagtcctgggagaaaatagtgatagcctagaattgtgtacccagaaaatccgtctttcaagaatgaggggccaggcgcagtggctcacgtctgtattcccagcactttgggaggccaaggcaggtggatcacctgaggtcaggagttcaagaccagcctgatcaacatggtgaaaccctgtctctactaaaaatataaaaattagctgggtgtggtggcatattcctgtaatcccagctactcgggaggctgaggcaggagaatcacttgaacccaggaggcagaggttgcagtgagccaagattgtgccattgcactccagcctgggcaatagaatgagactctgtctcaaaaaaaaaaaaaaaaaaaaaaaaaaaaagagggctaaacgcattttcataccacgaaactgccctcactccggagtttgctgccagcagagcctagagcgtctaaggcatgtctgggcttctggcgagggatcctgtggggaagctggagatggaagaaggagtgaataggcaggaaggtggatttgtgggcatgtctaaaacaccacatctagaagcttctacttagaatgcctacttttggagtttataaaaaagatgccacatgttgagttgggagagaggtgcccaaacctacagtgttctaaagtccccctactggtcggaaggagggcacggacactgacttcagcatctgttacaaggcttatcagagttttcagataatctctaaaagaatggaaatatatcttccaaactatagagggaagaccatggaatttaaaagccagtccttcaaggagaaatgaacaaactcaaaatcgtagttgggagtgttttttttttttttgagacagagtctcactcttgcccaggctggagtggagtggcataaacacagctcactacagcctcaaccttctgggctcagatgattctcctgcctcagcctcctgagtagcaggaactacaggtgtgagtcatcacactcagctaattttttttttttttttttactttttgtagagatggggttctcactgcattgcccaggctggtcttgaatttctgggctcaggtgatcttcccacctcagcctcctgagtagctgggaccacaggtgcatgctaatttttaaaattttttgtttttaaatgctggtcttcaactcttgtccccaagtagctgggattggggcatgaggcactgtgctaacttcatgttgaaattgaattgccattctaacagtgttaagagatggggcctgtaagaggtgattaggctgtgagggctccactctccaagggcggagttaatgttatgaaagggtaagtccagcccgcttgtgcctctcttgccctccagtgttcaaagcaccatcttggaggtggaattcccaagtcggccagttcctggatcttggactgtccggtctccagaaccgtgagccaataaacctctgttccttgtaaatgagtcagcctcaggtattctcttgtagcagcacaaatggaggcagacacttccttcaccaatctcatgggaggcccactcctgtgagctgcctctagttccccaggccacagactccatcagggctcacctggagccgtccctgtctcacctggaagctctcccactcctctggccagcctgggcatctccacccaatatgagtgatggcgactgattcccttactttagcaagctgggaataaggaatgtttgcctgttcttattcaggggtctctgcatctccacacttgcacaggttgtgtgtacatacattttcctgtctttctggtaagcccctggggtggagctctgggccacagggcaggaaaactcagtgttgctaggaactgccagacattttcccggagtgagtgcagcatttacattcccaccagaagtgtgccaggttcttgtcatactgcgtcctcgccagcgcttggtgctgtcagtcttcttagtttccatttagagattcagtgtttaaattttgaacgtcttgggtgaacaccttggtttgagaaaagtaagaaaaagggtctgtctggctatgggccatggagacccagggcagtgctccacgtgccaaccctggggcagggagcccaagctaggactgtgactgtctgggctgtgggcatctgaccatctccagtgtccccgtctttgatttccctggcgatggtgctagcttagtttgtgcgcatcggcatttgtgggagaaatgaaggattaatacattttgttttatgtcagactctctcagtgagaagttctcagggacaataatagcagggggtcctgctgaagaaaaactgggagatggctgagctctggtccatctttcattgattcattcatttcttcattcattcaaccatgtattgaatgcttatagccaatgaaaataaagtacacagtatatttta

SEQ ID NO: 141878 - DNA, 511 bp, Homo sapiens
  Payload ID: 7897
  Gene Symbol: IDNK
  Gene Name: idnK, gluconokinase homolog (E. coli)
  ENST ID: ENST00000376417
  CDS Start-End: 5-277
ggttatggcggcgccgggcgcgctgctggtgatgggcgtgagcggctcggggaaatccaccgtgggcgccctgctggcatctgagctgggatggaaattctatgatgctgatgattatcacccggaggaaaatcgaaggaagatgggaaaaggcataccgctcaatgaccagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccct

SEQ ID NO: 141879 - DNA, 692 bp, Homo sapiens
  Payload ID: 7897
  Gene Symbol: IDNK
  Gene Name: idnK, gluconokinase homolog (E. coli)
  Uniprot ID: Q5T6J7
  ENST ID: ENST00000376419
  CDS Start-End: 5-568
ggttatggcggcgccgggcgcgctgctggtgatgggcgtgagcggctcggggaaatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgt

SEQ ID NO: 141880 - DNA, 629 bp, Homo sapiens
  Payload ID: 7897
  Gene Symbol: IDNK
  Gene Name: idnK, gluconokinase homolog (E. coli)
  ENST ID: ENST00000405990
  CDS Start-End: 7-186
tgggttatggcggcgccgggcgcgctgctggtgatgggcgtgagcggctcggggaactgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactaga

SEQ ID NO: 141881 - DNA, 1210 bp, Homo sapiens
  Payload ID: 7897
  Gene Symbol: IDNK
  Gene Name: idnK, gluconokinase homolog (E. coli)
  Uniprot ID: Q5T6J7
  ENST ID: ENST00000454393
  CDS Start-End: 436-861
gggcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcgtgagcggctcggggaactaaggccagtctccagactccacggtcacgggcatcactgctttaggattacacagtgattggtgtttaaattcctgctaaggcagccatccctttcccagacatccttgcacagaaggaagctccacacattgggcagggcagtaacgggaacatctgtgtcctctccacagatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtccttggc

SEQ ID NO: 141882 - DNA, 1623 bp, Homo sapiens
  Payload ID: 7897
  Gene Symbol: IDNK
  Gene Name: idnK, gluconokinase homolog (E. coli)
  ENST ID: ENST00000533522
  CDS Start-End: 124-444
gggcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcactctcactctgtcgcccaggctggagtacagtggcgtgatctcggctcactgcaacctctgcctcctgagttcaagcgattgtcatgcctcagcctccggagtaactggggttacaggcgtgcaccaccacacccagctaagttttgtatttttagttgagacggggttttgccatgttggccgagctagtcccgaactcctggcctcaagtgatccgcctgcctcagcctcccaaagtgctgggattataggcgtgagccaagggctcaacctaacttggtcttaagtgtgatttctgctatgcacacttctggcttcaccagccatggagtttggccgggatggtctactcatccgtaggctgcatgtctccctgcgcagccttcaatagaatgaactaatgggaaaggtttcactgctctcgcaacctttggttacatccaggagcagatctcagtttggtacaactgtgtctaacacctctctgatagctttttagtgaaagaaagaggacctttgttaggcaacagtatccagctagaatttaatcacattgttctgttttcattatatacagcttttcaggtaccttctattcaagatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtccttggca

SEQ ID NO: 141883 - DNA, 607 bp, Homo sapiens
  Payload ID: 7897
  Gene Symbol: IDNK
  Gene Name: idnK, gluconokinase homolog (E. coli)
  ENST ID: ENST00000530832
  CDS Start-End: 338-607
gacgggaaggagccgagcttgggttatggcggcgccgggcgcgctgctggtgatgggcgtgagcggctcggggaactaaggccagtctccagactccacggtcacgggcatcactgctttaggattacacagtgattggtgtttaaattcctgctaaggcagccatccctttcccagacatccttgcacagaaggaagctccacacattgggcagggcagtaacgggaacatctgtgtcctctccacagatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactc

SEQ ID NO: 141884 - DNA, 7619 bp, Homo sapiens
  Payload ID: 7898
  Gene Symbol: IDS
  Gene Name: iduronate 2-sulfatase
  Uniprot ID: P22304
  ENST ID: ENST00000340855
  CDS Start-End: 211-1863
gccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacaactcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttattgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacaaaattgccatataatatcttgtcttttttgggggtgtgaattttttgcattgttctggtcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgcattgtttggggtttggttttatgcttactgtgtctctccaccccattatcagagtaatatatgctcattgcataaaatctggaacatgtgaaaactggagatgaaaagaagcccagcatttgagacatacccactgctgacatttgtatatttcctttcattcttttacctgcctaaagacatatatgcagatatggacatatttagctttacatacatgcagactaccacatataatctatatcttgtttttttgatctaacacaatgttagcttggttttttatgtcattgacagttcttgattaacagctgtaatggctgcacagccctgcttcattaatttttttttttggactgaaatgtatgtaccacgttccgcttatccattcatccaccagtgaccacttgggtcatttctaccttttggccattgcaataatgttgctgtcaacaaggatgtacaaatatctgttcgagtccctgctcttaattgttttgggtatacacccaacctacattaatctttaatcacttaagatgttggggtttgtgctgggaggtaaccaagtgactctggagcagcctcaccctagctacagagggaaactgactcttccctctctgcccaatcttttgccgcctgtcaggttcccaagctgtccataccttactgtgtgaagcgctttgggtataaactcccaaatagaggctcagccccttttcctttcccaagtccatcctgcaggttatagctcttcagaggaatctcttgaattctggcctgggatctgggattaaagtagaacccagggtgtcccttggggccttaggcatagcccgttgtggtggaacctgccatcagccccactgcactcagtggtcccctggtacttcaggacagtttctctcttctgcacatgagaacttcaagcagagaggactgtcagttgttgccttcacatcaccaatcgtttggccataatggccaagagccctcactgctcttgggtcttgcctttccacatgttactgaaagctcccgttggtgtccctgtccactaactcacctgatgggacagatgccactttcctctgagtgtctgataaaacacagtctgttgtggggagcccacgctcaagggttttctttgggatcagagtttcccggctattactccatgccctgcctgacatcactgtcatgtatggtgctaatcaccaaaggatgcccttgtttgattctggattctaggtgatagtccttatcctctgatgggggaagagtttgggtgggagagaacaaaccgacaagttggttccagatgaggtggctgggagccaaccctcaggtacttggctctgagtaatgtgacggcccaggcaagagggctcccactgccaatgaggaacaaaagctcaaggtctagtagtgtattcagcacatgctaggaaacaagagttgggacgtggacaaggagaggagcaaaggccaggggttaactgcttttggtttttcctctataaaagtcagggactatgatttatatgggtgagaaggtttggagtaggactgaagctgccatttacaaaccccttgccctaatttattgtagttttgggtgtgtttctgaaagaaccttttgcaggtgatttttattcagtactcattaacttacagcttttatgaattcacatcttctacactattgaaaaacataagtttgtattgtgttaagtgcagcatgagttattatatgaataaatcacattaaatttgc

SEQ ID NO: 141885 - DNA, 1399 bp, Homo sapiens
  Payload ID: 7898
  Gene Symbol: IDS
  Gene Name: iduronate 2-sulfatase
  Uniprot ID: P22304
  ENST ID: ENST00000370441
  CDS Start-End: 211-1242
gccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattca

SEQ ID NO: 141886 - DNA, 1213 bp, Homo sapiens
  Payload ID: 7898
  Gene Symbol: IDS
  Gene Name: iduronate 2-sulfatase
  ENST ID: ENST00000428056
  CDS Start-End: 144-683
ctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaa

SEQ ID NO: 141887 - DNA, 1529 bp, Homo sapiens
  Payload ID: 7898
  Gene Symbol: IDS
  Gene Name: iduronate 2-sulfatase
  Uniprot ID: P22304
  ENST ID: ENST00000466323
  CDS Start-End: 211-1149
gccccggaggggagggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggaggaccaaagttccacaggtttcagactgaagacttcatctaccagaaagtataagtaggccagggctcagcataatcctgctggaaggctagatgtatatcttttctcttgactgcaagtgagaacggcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattca

SEQ ID NO: 141888 - DNA, 959 bp, Homo sapiens
  Payload ID: 7898
  Gene Symbol: IDS
  Gene Name: iduronate 2-sulfatase
  ENST ID: ENST00000464251
  CDS Start-End: 1-321
aggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgcccttgtgggaacacatttttcagctgaatctttgttctcaagacctttttctgttagcattgggcctgcttcaagatgacagtagccaccactgtgtgccagggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgat

SEQ ID NO: 141889 - DNA, 572 bp, Homo sapiens
  Payload ID: 7898
  Gene Symbol: IDS
  Gene Name: iduronate 2-sulfatase
  ENST ID: ENST00000521702
  CDS Start-End: 314-572
agcattttatcatgtttgttggcgcttgtatgtcgtcttttgagaagcgtctgttcatgtcctttgcctggtttttaatggggttgtttttagcttgttgattttagttccttgtagattctggatattagacatttttggatgcatactttccttgacctcatgaggacgcccttcccaggacaggggggacatctgctgcttcccaaatgccacatttcttcaaataaaaagcagaagacagcatgcagtacataaggaactcatgtcttgcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccga

SEQ ID NO: 141890 - DNA, 2163 bp, Homo sapiens
  Payload ID: 7899
  Gene Symbol: IDUA
  Gene Name: iduronidase, alpha-L-
  Uniprot ID: P35475
  ENST ID: ENST00000247933
  CDS Start-End: 89-2050
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatatttta

SEQ ID NO: 141891 - DNA, 714 bp, Homo sapiens
  Payload ID: 7899
  Gene Symbol: IDUA
  Gene Name: iduronidase, alpha-L-
  ENST ID: ENST00000502910
  CDS Start-End: 42-714
agtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctgggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctcca

SEQ ID NO: 141892 - DNA, 697 bp, Homo sapiens
  Payload ID: 7899
  Gene Symbol: IDUA
  Gene Name: iduronidase, alpha-L-
  ENST ID: ENST00000514192
  CDS Start-End: 1-697
ctcgcccacccagggccggggattggtgctgggccttctcctggcagcgcgggccccagccccctgcccggtatggatggacgctgggccctgctggatccagaatccatcgtgagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacaccc

SEQ ID NO: 141893 - DNA, 796 bp, Homo sapiens
  Payload ID: 7899
  Gene Symbol: IDUA
  Gene Name: iduronidase, alpha-L-
  ENST ID: ENST00000509948
  CDS Start-End: 268-796
cgcgggccccagccccctgcccggtatggatggacgctgggccctgctggatccagaatccatcgtgaggtgagatgggattacgacaccaagcccatgccatggggtgtgctgaggccagcagtgctgaggggcggcgtggcggcaccctgtccaggctcagctccggcctattggctctgcggttcctggctgaaaaccaccctgtagcctcctgaagctcacctccccaacggggcaggaacaggctgggctgccaccacgcacatgtgcctaccgtcagaatgtcacagtcactggacacaggtgcaggcaagcctgagtccagctgctccgtgtccacctccctggctccccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtacca

SEQ ID NO: 141894 - DNA, 586 bp, Homo sapiens
  Payload ID: 7899
  Gene Symbol: IDUA
  Gene Name: iduronidase, alpha-L-
  ENST ID: ENST00000504568
  CDS Start-End: 1-586
gcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtct

SEQ ID NO: 141895 - DNA, 2130 bp, Homo sapiens
  Payload ID: 7899
  Gene Symbol: IDUA
  Gene Name: iduronidase, alpha-L-
  ENST ID: ENST00000514224
  CDS Start-End: 453-2018
agcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcggaatgcaggcctcgtgggaattcagccccatctgcaagtgcagtggcagggcggcccccttctcccttgacgacgcctgtcccctcggaatgcaggcctcgtgggaattcagccccatcgggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatatttt

SEQ ID NO: 141896 - DNA, 3458 bp, Homo sapiens
  Payload ID: 7900
  Gene Symbol: IGIP
  Gene Name: IgA-inducing protein
  Uniprot ID: A6NJ69
  ENST ID: ENST00000333305
  CDS Start-End: 2543-2704
gggaaagatttttgagtctacaactgacaaaatgtcttcttcaaattaaaaaaaattgagaagcagcactttaagtctaactctacaccattttattgcatgtattagttttattaatgatttttggtgcatgcctttgggcttattcaaaagtgtacaataggaaagtatatttcctttcttagaaaggagatgttttctactttgcaacatgtgattacaaaaatcttcctctgtgggaagattaaccatgtattgaactactgaaaagtatatatttttagatatacagaaggaatctacatggagcagcattcagacctatatagaagtcatagcattctgtataggaccaaaaaggaaataacattaaacacttaaacagacgttgttgggtagaaatacctttagatcttgcatttacttccaaaaagaaaaaatgccacagaagtttgctgaaaacttttgtcgtttgaattttctctgtcagtgtatttagcccaaatacaacagctttgggttagcacacacataagaatcaaaaaaacaaagctcactaaataaatcagtctggtttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacagtttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattattttaagattatattgcagagttgctttattttgagctttttgtgtatacacaatcccaaactggaagaaattttaaaaaaaggaatcctgctgtgaaaggtatatattactctagatttttcttactgtaaatattgtaagattgtaatactgtcgatattttattaaccaacaaatgttaatctatgtgaaatcagacttattttaaatgtgcttcttatttactgtgtgtggtccctgttgctgacagtattaagttatattctgatgtaagattaactttattaaagaatgtaaacattaatgtttccttatgggaaaacaaataaagtataaagaagacaattcttttcattgaaatatactgtgtatttacacttgctagacccagcaccacttataaatttagtacactgttcagaattttagttaacacagctgacatggttgtgctctgtttgaaagtctaagaataggtattgttggaatatacagtttgtatttgtctgctgtgaatcataatcttgaaatttctaatcaagtttgtaaaatttttatagtgaaacattttaatgacaatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttggggaccccatttaagaatgctgaattttgccaactaagaagtaagcaaatgcaatttaaaaagtaaatttgagcattctgtattaaatatgtgcagttattatcacatgaagaaacgcagtgtgtcgggctgtaatattaccatatttgctgtcatgttctcccatctcagtgctgggaaatcaccatgtggaaaccaagcaaacgtgttgtgcatcagccggcttgagtttgttcaatatcaaagctgaaaactagcgaggtctgctgtactgcttattgaagtattgtgattattttaggcattgattcttacaaaatatatactgtaacagtatactttgtacagatttaaattttatttgaaaaaatgaaataaagtaggcaaaaaaataaagatgtttatttttcatgtgactgtataatcagatcagtcttttgtttcagtgctttttgggggaaggggtctggttgcgatcttggattttttttttttttgataggtggaaactttttaggactcagtagcaggtatacttatgcttatgaattggctgcaagcattaagtgtgctctcatactagagaactctatcttctattttattttaaggtaggtttgcttatttttaaaaatgttatgtgaatggcctccctatcctggcatactgggtcatttaaaaaattctctggtggtatgacagtgaacctagccatcatgttgaagagaagggaaaccttttcccaaagatcatgctccattctcatggaaggttttttgttttctgtcagttacaataaaaaaaatgtaattatcatggatacatactagttatacatacttatggggtacatgtaacattttgaaacaagcgtacaatgtactgattaaatcaggatgattggggtatccatcacctgaagtatgtataatttcttcgttttaggaacattctaattccactcttagttatttgaaatatataataaattatttttaatagtt

SEQ ID NO: 141897 - DNA, 769 bp, Homo sapiens
  Payload ID: 7901
  Gene Symbol: IGFL1
  Gene Name: IGF-like family member 1
  Uniprot ID: Q6UW32
  ENST ID: ENST00000437936
  CDS Start-End: 24-356
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaa

SEQ ID NO: 141898 - DNA, 607 bp, Homo sapiens
  Payload ID: 7902
  Gene Symbol: IGFL2
  Gene Name: IGF-like family member 2
  Uniprot ID: Q6UWQ7
  ENST ID: ENST00000377693
  CDS Start-End: 37-396
gcactgctgctgtcccatcagctgctctgaagctccatggtgcccagaatcttcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgta

SEQ ID NO: 141899 - DNA, 885 bp, Homo sapiens
  Payload ID: 7902
  Gene Symbol: IGFL2
  Gene Name: IGF-like family member 2
  Uniprot ID: Q6UWQ7
  ENST ID: ENST00000434646
  CDS Start-End: 292-684
tttgggtttggacgggtgcgtttgtttctcatagtgcaggtctggagccggactgagatggggagtagagggaccccttgaaacttcagggtggatgaatatgaagtttcatcaccagctgtgatgtttgatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggagtgtgctggctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgta

SEQ ID NO: 141900 - DNA, 455 bp, Homo sapiens
  Payload ID: 7902
  Gene Symbol: IGFL2
  Gene Name: IGF-like family member 2
  ENST ID: ENST00000601052
  CDS Start-End: 1-255
cagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgt

SEQ ID NO: 141901 - DNA, 662 bp, Homo sapiens
  Payload ID: 7903
  Gene Symbol: IGFL3
  Gene Name: IGF-like family member 3
  Uniprot ID: Q6UXB1
  ENST ID: ENST00000341415
  CDS Start-End: 26-403
attctcctagagcatctttggaagcatgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggaacaggaggcacgtcctgtacccataaaaaccccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatct

SEQ ID NO: 141902 - DNA, 573 bp, Homo sapiens
  Payload ID: 7904
  Gene Symbol: IGFL4
  Gene Name: IGF-like family member 4
  Uniprot ID: Q6B9Z1
  ENST ID: ENST00000377697
  CDS Start-End: 55-429
tcactgacccatttccactgctgctccctcgtccgctgctctgaagcctaacccatggtgcccagaatttctgctgccatcttcatttttgaacttttgggttcaaactcagaaggagtcacagatcttagactgtggctatgccagccagcgcccaggtgcggggagtggacctacaaccccttggagcagtgctgtgatgacggtgtcatcctagacttgaaccagacccggctctgcggctccagctgcaccttctggccctgcttccagcactgctgcctggagtctttgggctctcagaaccagacagttgtgaggttcaaggtcccaggcatgaagccagattgcaagtcctcccctatcaccaggatctgtgcccaggaataccacccaaaaagccctgtgtcaagatctgacctcatctagactgttctggggtagcagagtcacagatcactctagaatctaatacttggtaattatactgcattgattttgttgttgttgtgacagagtttcactctgtcccccaggctggagtgcaaataagcaacttcagcaaagtctcag

SEQ ID NO: 141903 - DNA, 667 bp, Homo sapiens
  Payload ID: 7904
  Gene Symbol: IGFL4
  Gene Name: IGF-like family member 4
  ENST ID: ENST00000601672
  CDS Start-End: 507-599
aacttcgtggtggatgatgcctgtaactacccagatgaaatcaagacgcaacagccctcatcgagggatgctcagagtcaaggaaacttttcttttgagctactgacagcttaactcctgtgaacaaaatttggagcatatttgtttctctctgcctgatttctccaaaatttggaaactatttctctttttgcctaactcttcccaagaaaccactccttctgcacacctccctaaatggcgctgccatcttcatttttgaacttttgggttcaaactcagaaggagtcacagatcttagactgtggctatgccagccagcgcccaggtgcggggagtggacctacaaccccttggagcagtgctgtgatgacggtgtcatcctagacttgaaccagacccggctctgcggctccagctgcaccttctggccctgcttccagcactgctgcctggagtctttgggctctcagaaccagacagttgtgaggttcaaggtcccaggcatgaagccagattgcaagtcctcccctatcaccaggatctgtgcccaggaataccacccaaaaagccctgtgtcaagatctgacctcatctagactgttctggggtagcagagtcacagatcactctagaatctaatacttggtaattatactgcattgat

SEQ ID NO: 141904 - DNA, 1645 bp, Homo sapiens
  Payload ID: 7905
  Gene Symbol: IGFLR1
  Gene Name: IGF-like family receptor 1
  Uniprot ID: Q9H665
  ENST ID: ENST00000246532
  CDS Start-End: 99-1166
cacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttgaagtacaatcctaattgggcaaagacccaacagatagcctcactgctcttcgccctagaagggcctattccaacatacacacagggccacatgtgggagggctgaccccaggtgcctctgggccaccagaatcccctctgggaaacaaccctgctacagacagttgctgtgttgtgttgttctgaagccgtaacagaccccatgactgacttctaattctgaatgatggcctcacctacctgttgaggctgatgaacttccttgggtcatgatgggtgggtgtgtagaagtggggttcctacctgcccccacagcctacaaatgggaagaccacctctccaaacattgacagactttattgtgggggggttcccacctgggaccccacctcttaaataaaaaagtgcatagaaaa

SEQ ID NO: 141905 - DNA, 730 bp, Homo sapiens
  Payload ID: 7905
  Gene Symbol: IGFLR1
  Gene Name: IGF-like family receptor 1
  ENST ID: ENST00000588992
  CDS Start-End: 102-665
ggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccgggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttga

SEQ ID NO: 141906 - DNA, 1195 bp, Homo sapiens
  Payload ID: 7905
  Gene Symbol: IGFLR1
  Gene Name: IGF-like family receptor 1
  Uniprot ID: Q9H665
  ENST ID: ENST00000592537
  CDS Start-End: 102-1169
aacttcagctgaggaacttggcacggccagcttgggacccaggaccctaacggtactgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgacta

SEQ ID NO: 141907 - DNA, 782 bp, Homo sapiens
  Payload ID: 7905
  Gene Symbol: IGFLR1
  Gene Name: IGF-like family receptor 1
  Uniprot ID: Q9H665
  ENST ID: ENST00000592889
  CDS Start-End: 156-659
gttgggggatgagggctcgggggtagattcccggcttccgaagaggcgtgagaattctgttcccccacatcaccgcgtcctttcttctgcccgatttccccggaaagtgtagcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttgaagtacaatcctaattgggcaaagacccaacagatagcctcactgctcttcgccctaga

SEQ ID NO: 141908 - DNA, 200 bp, Homo sapiens
  Payload ID: 7905
  Gene Symbol: IGFLR1
  Gene Name: IGF-like family receptor 1
  ENST ID: ENST00000586140
  CDS Start-End: 153-200
ctgtcttggcctcccaaagtgttgggattacaggcatgagccaccacacccagcccctgctttacttctaatgacggttctaattctccacaataaccctatgagacagcagaggcgctgtgtttggaagtcccgctatcacggccccccagatggggcctggacgatgcctcctgacggccttgttgcttctggccctg

SEQ ID NO: 141909 - DNA, 1148 bp, Homo sapiens
  Payload ID: 7905
  Gene Symbol: IGFLR1
  Gene Name: IGF-like family receptor 1
  ENST ID: ENST00000588018
  CDS Start-End: 60-458
acccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctga

SEQ ID NO: 141910 - DNA, 581 bp, Homo sapiens
  Payload ID: 7905
  Gene Symbol: IGFLR1
  Gene Name: IGF-like family receptor 1
  ENST ID: ENST00000591277
  CDS Start-End: 168-581
ataaccggctcagttgggggatgagggctcgggggtagattcccggcttccgaagaggcgtgagaattctgttcccccacatcaccgcgtcctttcttctgcccgatttccccggaaagtgtagcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgc

SEQ ID NO: 141911 - DNA, 593 bp, Homo sapiens
  Payload ID: 7905
  Gene Symbol: IGFLR1
  Gene Name: IGF-like family receptor 1
  ENST ID: ENST00000592693
  CDS Start-End: 1-182
gcggccgccttgaatactggaacccagacaacaagtgctgcagcagctgcctgcaacgcttcgggccgcccccctgcccgggtgagaatccgagaccgagccttgcttgggcggagcttgcagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcc

SEQ ID NO: 141912 - DNA, 329 bp, Homo sapiens
  Payload ID: 7905
  Gene Symbol: IGFLR1
  Gene Name: IGF-like family receptor 1
  ENST ID: ENST00000591748
  CDS Start-End: 1-224
aaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccag

SEQ ID NO: 141913 - DNA, 434 bp, Homo sapiens
  Payload ID: 7906
  Gene Symbol:
  Gene Name: IGHV2-70
  ENST ID: ENST00000390634
  CDS Start-End: 77-434
atctccaccagctccaccctcccctgggttcaaaagacgaggacagggcctcgctcagtgaatcctgctctccaccatggacatactttgttccacgctcctgctactgactgtcccgtcctgggtcttatcccaggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatggaccctgtggacacagccacgtattactgtgcacggatac

SEQ ID NO: 141914 - DNA, 434 bp, Homo sapiens; identical to SEQ ID NO: 141913
  Payload ID: 7906
  Gene Symbol:
  Gene Name: IGHV2-70
  ENST ID: ENST00000632005
  CDS Start-End: 77-434

SEQ ID NO: 141915 - DNA, 2606 bp, Homo sapiens
  Payload ID: 7907
  Gene Symbol: IGLON5
  Gene Name: IgLON family member 5
  Uniprot ID: A6NGN9
  ENST ID: ENST00000270642
  CDS Start-End: 1-1011
atgcccccccctgcgcccggggcccggctccggcttctcgccgccgccgccctggccggcttggccgtcatcagccgagggctgctctcccagagcctggagttcaactctcctgccgacaactacacagtgtgtgaaggtgacaacgccaccctcagctgcttcatcgacgagcacgtgacccgcgtggcctggctgaaccgctccaacatcctgtatgccggcaatgaccgctggaccagcgacccgcgggtgcggctgctcatcaacacccccgaggagttctccatcctcatcaccgaggtggggctcggcgacgagggcctctacacctgctccttccagacccgccaccagccgtacaccactcaggtctacctcattgtccacgtccctgcccgcattgtgaacatctcgtcgcctgtgacggtgaatgaggggggcaatgtgaacctgctttgcctggccgtggggcggccagagcccacggtcacctggagacagctccgagacggcttcacctcggagggagagatcctggagatctctgacatccagcggggccaggccggggagtatgagtgcgtgactcacaacggggttaactcggcgcccgacagccgccgcgtgctggtcacagtcaactatcctccgaccatcacggacgtgaccagcgcccgcaccgcgctgggccgggccgccctcctgcgctgcgaagccatggcggttccccccgcggatttccagtggtacaaggatgacagactgctgagcagcggcacggccgaaggcctgaaggtgcagacggagcgcacccgctcgatgcttctctttgccaacgtgagcgcccggcattacggcaactatacgtgtcgcgccgccaaccgactgggagcgtccagcgcctccatgcggctcctgcgcccaggatccctggagaactcagccccgaggcccccagggctcctggccctcctctccgccctgggctggctgtggtggagaatgtaggcgcaacccagtggagctcacctccccctgcagggggcctcaggccaagagtgagagaaacgggggagcaagagccgtgggtctcgtgggggcagaagagctctcggccaccaaggaagaagagagaggagaagaggaggaggcagaggaagaaagatcttcagagaacccatcactgtgagggataacgcaaaattatgcatctttctacagccattctcgccacccgttcacgtttccgattgtgacccactcccgccaccccatacccctctctcttagctcaggctgtcaactggcttgtgtgggtgtgggtgtgtgagtgtgagcctgcatgcatgtgtaggtgtctgtgtctctgtttgtgtgtgtgtgggggggtgggctgggggaagggactcagccgtcctcccgcccccaaaacccccatgtccactgtccccaaccctattgcctctcacctctggctggaggtaggtatgaggctctgcagtggaagctgtgaagagaggcttaccaggctccctgcttccccaatatatgcacgcacactacccctccccctgtcgaaagggcaactcctggcaggttgggagtggggaggggcatcgcactcacctgtcaagctgtcattcagcctttgtgagtaagtgggggacctccatctaggctctgggcttccctgctgtcaaccaccagcttcctgtagccagaggccccatcgctggctcagtggcctgagaccttcccacttttcctgtccctccacaccctggattttctggccccctcctgggccaatcggtgcttccatccaactgtcagactggtggcaggagtcacctgtctgtttcagtgctttgccctacccttgccaccactccccttggccttgatttccccacctgcggcaccagccagctgcccttggggcctttgcagctggcccacaggtgtgagcttgctggtctatcacttcctggcctctccaccaactgtacctcccaaaggctacctgaccgccctcacagacactcagacgcaccacacacacatacacacacacagacacacacacacacacacacacacacaccagcgactgtgaccagcaatagccccctggctccagctgtccggtagctggtgactagctgtatttccccctgggtaggcatctggtgtcaggaagggacgctgagaggccgcagcctcagctctgactgtaggaacactccaccctggtacaccacaccacacaaagtgggggacagagaggcatcacacagacatcctgagcccagacaaagatgccatgtcaccaactccgactcccaggagaccctctatataaacacccaccccaaaccacaccacccagagtctggtggagaaaaggagagggcaaggcgcagtgactgtacctcagacgggggcatgggccccatcccacattgtcttccattcccagggtccaggggatggggtgggacaggggagggatgctagggagggggtggggggccctgggggccatgtgttccaattcatggggagtgttgagaccaccacaccaataaacgcctttttccaaa

SEQ ID NO: 141916 - DNA, 1962 bp, Homo sapiens
  Payload ID: 7908
  Gene Symbol: IK
  Gene Name: IK cytokine, down-regulator of HLA II
  Uniprot ID: Q13123
  ENST ID: ENST00000417647
  CDS Start-End: 140-1813
gggaaaaacaggaagcggaaaggctgcgaacgcaaagcagtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgc

SEQ ID NO: 141917 - DNA, 540 bp, Homo sapiens
  Payload ID: 7908
  Gene Symbol: IK
  Gene Name: IK cytokine, down-regulator of HLA II
  ENST ID: ENST00000503332
  CDS Start-End: 81-302
gcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccagctggaatgcagtggtgcgatctcggctcaccacaacctccgcctcccgggttcaagcaattctcctgcctcagccttccgagtagctgggattacagatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcag

SEQ ID NO: 141918 - DNA, 868 bp, Homo sapiens
  Payload ID: 7908
  Gene Symbol: IK
  Gene Name: IK cytokine, down-regulator of HLA II
  ENST ID: ENST00000508301
  CDS Start-End: 68-868
gagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggag

SEQ ID NO: 141919 - DNA, 489 bp, Homo sapiens
  Payload ID: 7908
  Gene Symbol: IK
  Gene Name: IK cytokine, down-regulator of HLA II
  ENST ID: ENST00000507593
  CDS Start-End: 68-489
gagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgatgaatttctcgtctcttctaggatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctga

SEQ ID NO: 141920 - DNA, 569 bp, Homo sapiens
  Payload ID: 7908
  Gene Symbol: IK
  Gene Name: IK cytokine, down-regulator of HLA II
  ENST ID: ENST00000513256
  CDS Start-End: 249-569
atacttatgttgcccggaatacaacgcatcatataaccctgcgaatataaatttcttcatggaaacaagatcaacagcaaggctaaagtccgagttctagtttctccacgggtttctgcacgaccttgggcggtcccttctcttctcaaacccttgttcccctaccggagccccagacccctggcgtcccgcactcaccgtagcgggcccagagcttgggctgcacatcggagcattcgcggattaggatgggtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaac

SEQ ID NO: 141921 - DNA, 690 bp, Homo sapiens
  Payload ID: 7908
  Gene Symbol: IK
  Gene Name: IK cytokine, down-regulator of HLA II
  ENST ID: ENST00000502899
  CDS Start-End: 54-690
gtgaggccgacagctccaaactccgtccccagtcctcactcctactccaagtgatgatgggcggcttttgtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgg

SEQ ID NO: 141922 - DNA, 1857 bp, Homo sapiens
  Payload ID: 7908
  Gene Symbol: IK
  Gene Name: IK cytokine, down-regulator of HLA II
  ENST ID: ENST00000620556
  CDS Start-End: 35-757
cgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggccatgtggtagacctggatgatgagtatgctgacacagatatccccaccactcttatccgcagcaaggctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgct

SEQ ID NO: 141923 - DNA, 737 bp, Homo sapiens
  Payload ID: 7908
  Gene Symbol: IK
  Gene Name: IK cytokine, down-regulator of HLA II
  ENST ID: ENST00000610522
  CDS Start-End: 37-525
gggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaagggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggg

SEQ ID NO: 141924 - DNA, 6189 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000331340
  CDS Start-End: 156-1715
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 141925 - DNA, 5376 bp, Homo sapiens
  Payload ID: 7909
  Gene Symbol: IKZF1
  Gene Name: IKAROS family zinc finger 1 (Ikaros)
  ENST ID: ENST00000346667
  CDS Start-End: 156-905
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcaggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtg

SEQ ID NO: 141926 - DNA, 5757 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000349824
  CDS Start-End: 156-1286
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtg

SEQ ID NO: 141927 - DNA, 5925 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000343574
  CDS Start-End: 156-1454
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtgggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtg

SEQ ID NO: 141928 - DNA, 5925 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000357364
  CDS Start-End: 156-1454
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtg

SEQ ID NO: 141929 - DNA, 3487 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000359197
  CDS Start-End: 156-1589
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattc

SEQ ID NO: 141930 - DNA, 1808 bp, Homo sapiens
  Payload ID: 7909
  Gene Symbol: IKZF1
  Gene Name: IKAROS family zinc finger 1 (Ikaros)
  ENST ID: ENST00000413698
  CDS Start-End: 210-734
gactgcgcggcccgcgcccggggcggtgactgcggcaagccccctgggtccccgcgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggttacatatggggctgatgactttagggatttccatgcaataattcccaaatctttctctcgtaagtatatgccttgcttctggaaaacaaaagcatgccttcatctcctatcatgtaaatatcgtacgtgcatgttccttcatcaacccccgagatacattaaatattcactgttctattcgttagacacctaccatatcatttttgggtatttataccataaagtgcaaaacgaaggtctaggcagttgtgcggtgtcctgggagcatggcagtggagtaacagtaagggttggagtcacagtagcactgatgggattgttacttcgcagatgctgctggacagctttgagattactcctgtaatcctttttattgagtgtgaggataaaatggccatattttctgtcaccaacaaagaactgaacatggtttcaagataatttttacaattttgtgggacaggagaaggagatatgctcttcatctgtggttctggagtattaatttcagaactgagaagagaaaattgcaggcctccaggccgttattctgtggtgcatcgctgctggagccaacgtactgttcctgcttggtgcccgcaggaccttctctgatctgagctgttaaaccaaaaacagatgtgaatttcatttttcttttttagatattgagctgataaatgataaatatatttgggtaacatcctcaaatgagtactttaaagaacagagagtgcttttgaaaatgtatagagagctgaatatttaaagccatacaagttgataatccccttaggacctgtattagtaaatcctctaatactataaagcaacatcagaaaacaggtcgcatttgttaacactgtgacaattataattataggctctaatttgaacagtgccagtaacagttaaagacaggtgtctgacatcctggttatcaaaaactatctggtgtctaaggaatttaacagtatcaaagtacatctttttgctcacaaactagattggctacttttccagcctatagaagttacagaaatctttcttttactgatattcctttgattccactttaaagcaatagcttgatacctactttttgagatgtatatgtatgtacttgtaaatgcttatatatgtgtatttgtttacacgtgagcttatatgaacatataaaacattatggtattggacagagaaatgatattgatttgaagaatcatattgttgaagtattttgagaagtcaaatgcacttgagagtaagctaatgcatcctaaaacatgtttctgtgaagtctgaggaaggtgtcagccagagcatatgttgaagcagacccttcagtgaagccttcagtctgtaagaatcgctgcatgtgaagatgtgttaatgttatgatagttacagtttttataaaagagatgatatacacttg

SEQ ID NO: 141931 - DNA, 1748 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000438033
  CDS Start-End: 201-1499
agtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtgggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttcc

SEQ ID NO: 141932 - DNA, 5511 bp, Homo sapiens
  Payload ID: 7909
  Gene Symbol: IKZF1
  Gene Name: IKAROS family zinc finger 1 (Ikaros)
  ENST ID: ENST00000440768
  CDS Start-End: 156-1040
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtg

SEQ ID NO: 141933 - DNA, 201 bp, Homo sapiens
  Payload ID: 7909
  Gene Symbol: IKZF1
  Gene Name: IKAROS family zinc finger 1 (Ikaros)
  ENST ID: ENST00000426121
  CDS Start-End: 1-201
ccccctgtaagcgatactccagatgagggcgatgagcccatgccgatccccgaggacctctccaccacctcgggaggacagcaaagctccaagagtgacagagtcgtgggggacaagggcctgtccgacacgccctacgacagcagcgccagctacgagaaggagaacgaaatgatgaagtcccacgtgatggaccaagcc

SEQ ID NO: 141934 - DNA, 3572 bp, Homo sapiens
  Payload ID: 7909
  Gene Symbol: IKZF1
  Gene Name: IKAROS family zinc finger 1 (Ikaros)
  Uniprot ID: Q13422
  ENST ID: ENST00000439701
  CDS Start-End: 200-1633
gtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttgataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaa

SEQ ID NO: 141935 - DNA, 5637 bp, Homo sapiens
  Payload ID: 7909
  Gene Symbol: IKZF1
  Gene Name: IKAROS family zinc finger 1 (Ikaros)
  ENST ID: ENST00000615491
  CDS Start-End: 156-1166
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtg

SEQ ID NO: 141936 - DNA, 962 bp, Homo sapiens
  Payload ID: 7909
  Gene Symbol: IKZF1
  Gene Name: IKAROS family zinc finger 1 (Ikaros)
  ENST ID: ENST00000612658
  CDS Start-End: 156-962
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggttacatatggggctgatgactttagggatttccatgcaataattcccaaatctttctctcgagaacggcccttccagtgcaatcagtgcggggcctcattcacccagaagggcaacctgctccggcacatcaagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaa

SEQ ID NO: 141937 - DNA, 3747 bp, Homo sapiens
  Payload ID: 7910
  Gene Symbol: IKZF2
  Gene Name: IKAROS family zinc finger 2 (Helios)
  ENST ID: ENST00000342002
  CDS Start-End: 152-1750
gggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattat

SEQ ID NO: 141938 - DNA, 2001 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000374319
  CDS Start-End: 311-1813
gctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaaca

SEQ ID NO: 141939 - DNA, 1401 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000374326
  CDS Start-End: 1-159
atggaaacagaggctattgatggctatataacgtgtgacaatgagctttcacccgaaagggagcactccaatatggcaattgacctcacctcaagcacacccaatggacagcatgcctcaccaagtcacatgacaagcaggtctttttcaaaaatatagaattagaagtgtcctttgatatacttctgttccttgccagattacattcaaccattaatttaaggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggcc

SEQ ID NO: 141940 - DNA, 1763 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000439848
  CDS Start-End: 1-447
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggggtggcagtggtgaaaactaccttttcagaattctgctagtattggattgcagaaaaacagagagtagcctgggtcttgacttccagccttcaaatctgaatagcatatcagaaaagaagtttgggattcagtttccacagttcttaatatagcaataatatgataagggttcaaaaggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggcc

SEQ ID NO: 141941 - DNA, 551 bp, Homo sapiens
  Payload ID: 7910
  Gene Symbol: IKZF2
  Gene Name: IKAROS family zinc finger 2 (Helios)
  ENST ID: ENST00000442445
  CDS Start-End: 59-337
attgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcagtaagtcttcattttatgatttttttttgtgtgtgtgtgtctctccagcaacagactttaatttgttaggtctgtggggtcctctcacattgtggtatagctactgttatagattttgctaaagaaagaacaacacagatttattcctgttcattctagtattataaaacatgagcctgcttactagtctgaactatcccaaggtggcatttgggagctggtgcttacctgtatcaggtaagaaaggttagaatttgctggttgttgttttgacttgccaggtttatgactggattttttgttgttgttgggtaaaaaatgtggaaacgtcacttc

SEQ ID NO: 141942 - DNA, 9344 bp, Homo sapiens
  Payload ID: 7910
  Gene Symbol: IKZF2
  Gene Name: IKAROS family zinc finger 2 (Helios)
  ENST ID: ENST00000451136
  CDS Start-End: 446-1675
aaccctgctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattatttttgggaaaatgtccaaactgccccctttaaatctaagggaatgcaccaaaacagagatatatagaatgtcaaccatttcatttttttttttctgcatgccttggtacatagtgaacatacaacctatttaaagataaagcatgtttttgagactcgctcacccccccccacccaaccactcccaaataataattgggatgccattttttttccttttggatgaggtaaataattttaaggttcacaattttgtcttttactgcaatttaaggaaacatttggatgtcagtcaatatgttcataattttggctgtgtgcgaatttctgctggcattatctatgaattttcttcctacttatttttttttcagtatatgaacaatcatgtatctacctgccccaggatgaaactaaatttaggtggaccctaaaccttatgaagacagtgctgaggcactttccttttctgatttcatctttttgggaatctgttttattgaaggtagttagtagttgagagtgcatttgctacaagcatatacttgtatcttcctagcttcatgaggaacagaaagaggtggatatggctcagggtgtggcagggacaattgaggacaaagtcaattcaaatttgtgggtcagaaagaatttttgtggacgtagtgtttttggagaaactctggatggttatatgtgcatgccttttcttcaaaaggaaatacgcaaggttgtagcatctaaaaataaacataagagtcagacaccaaataaatcaagttttacataacagttgtatgcccagtttgtttaggtgagatttcacattacagaaagtatttgaggagcatgaaaatgggttatcttctgtattttccagtttggcaaaagttcagaatttcatcacattgctttgccctaattttgcccagaattttatcttagcctctctctgacagtgatgaatcatgctcaaaagccattctaattggacctttttaagacagggaaagggatcagtaggcggattggaagaaatttcaagtcattgaaatattccattgagatttcctaaagggacaaaattgggaaaataagaaactacgacttagatttggctacgtagtagaaagtatctcccctacatacatacaggcaattgtatgtatgaatcatagggtatatgtgtgtgtatactacacacacattcttttaaagagaattcatggaaaaaaaagcagttggagtgatcagatgtattgcaaaaacatacagagaatttaaatgacagttaataccaagaaattagttgggtttactttatcaggtcgtaataggaatcactaaagaagttactagtgtgtctttaggaccagtggcaactcttaaactaaaactttgggtccttattatctacttacagaacaaagtgaaacaaacaatgattaagctgattggatatacattcaaagatatttaatgtaaagttttttggaatacgaagaaaattcagaaaataaatattatcaacagttacttattggcaaatagagaaagacaagaatagtttagtgagcccggtattttgtttttatagtttttatctcagttgtacaactcacaaaaccatgaagtctttggtattttataaatgtttaacaaaatttacatcagattaaggcatttagatgaaaattattatgttctcactatcttccaaattttatttcatcctatctccaaaatgatttcttagggtacaaaaagagcagacggggctgtaaaaatacaagcaaaaaactgtgtgcccctagtttcaggcagaacttaaactgtcagaggtactagctacatgatttgttttttaactttggattgttcacgtccaaaaatggataaattacatttgtgtttatcatcagttgcattttatgtattattttaataaatactatctgaatgaagactattctaaaccagaaaattccccaaatccaaaagaaaaaaaaagtgggaagaggtgaaattgaagtttgtgtatatgaaagttatcttagacatatttttaattctccagtttctgcaaaataattaaaatatacagtaactggtctcctaaatcctgaatttaatgtattaaatacttatgttctttatattggtgcctttttaaaatgcattgagagtgttggttagctgttgcagctgtacaacacttttaatatgcatttttaaaaatcacttaaaattgagtactatataattcatctctgcatttttagtgcaaatctttagagcaatttctaatagagaaattttcagctcagctgttaaaaggaaaaggaaactttgaaactagactttactacctttttagtttcatagtatttctgaatatgattacaagattatgcaggtaaaatatagagtgaaactttacctgtgaattgaattataatttgtgtttttgttttgtttttaaggaagaataagttctgtatcaaacaagaatttattagataattttttggtcaataaaatacagtattcatttggattttcatctccagactagtattgttctagtcttggaatctgtattttctaatctgttagaaaatagagattgaaaattgatggaataatgtgaaaaagcaggtaattaattctccttgaacaaagcaaaactgaacagtcatatcacattgctattctccaaagcataatctcaaatggtttcatatcatggttgtgtattacttgcaatgggtgtgttaggatatgacagctttttaaaaaaatgagctgctggttatacaaagcaaatggcatatgaccaagaagctgtgatatgctagtgtttctttttatcatagtgtattactaggccaaataatgacaccttgaatatttttacatttattgcagaaaccttaaactttggaatttccataaggtttttatgtaatattctatttctagctttttagttttatcttgctgtactgtaagtttgaggatatttttcacctgcactcttaggaataagttcataattctgtttatggggctttcctcccataacactgcatttgtatattttctgtataaaatatgtgttgtgtattaacctttatcccatacagagagtggtacatgaatgactagttttctaagatgtcctttttattgtgaataaaatataaaagttaaaggccctctgctaagtcacataaagtacagcatataagttcatataggtacaaataaatgagtttgcagtgaattgggccttcaaattacctcaagtgacagatagtaagaaaagcttcttgagcaggtggaggtcactgaatcccctactatgcacttaccaagattttacttactttaatttactggaaattgattttttaaaaaatgactacactgtaacaagggaagggatctgggtttttttgttgttttattcttgttttttttaagtagttcaaattctgaaactgtgatttaaaaattttttacagtcaagcattctgattttgaacataactcccttccctttctgtgtaacaaaggtctctctgttatctcttaaattttgttacatctccctcagcctctttctttgtccgtctcccttctgtcattgtctatggatgtttacctctctgttctcctaaaagtttgaagattaggtcaactcttatttctagttcattggtaatttaatcttaatttttttttcgtgatttttgttggttgtataatctgctgacgtatttttatactcaagtgtagttttctattaaaaagaaaagtggttggattaaaaatagtaagctatgtaaccctcatgttactttcactttcaaatattgggtacctaaaacattacttcagagattatgtaatcctattatagtatgtttgctttcctttattgttggattttacattctgatttggctttcctccaaaaaatgtatatcatgaaagactagacagttatttgcaagtgtttagaaaggtgttaaaaatgtaaagcaaagagtcttaactttctcctaattgggagaaaaatgctttaacattactataataatattccaggtttggagggggtctccaggccccatatttgctgttaatagttggaccttttagaccatgtgttatttgcaatcccagaatgattgcttctgctattagttaaaaagatactattcttttctttctgtacaagtgcaatactccccttgaagtcttaaaaactatggtgatttttttttcttttctgacctattcttcctttagctaatgacaaaaagaaactcataaaagtcatagtatgttaaaggacacaacaagcaaagagaaaaacactccacaatcaaaagattacagaatgtggaaaccactagtctgatctcatggtatctttatttaagctaaatttccatggaaattagtaatcttttgcttgaaaaatgtgtcctaaagttgaactttttacagattgaatcttcttagaccctcgcccaatgctctaaattaagaacctaatacttaatatttttattttacttctccccttttagaaataaacttttaaataaaagcaaagcacttagctgagttttaaacacttacatatcacctattggagaaattttttttaaaaatatttggagcagtcctgttttcatacaaatttaagtaagaggtatttttcttatacatatttatatgtagtgtgctaattttctttttttatacctgtgtccctgtagtaaaactgctgtaatataaatacatgttttgttaaaagataacatttctttggcatttcttttaaaggcagttactgcatttctgcatttgtacagtatgtgtcttggccattttagatattctttctttaacaataccaaaggtaattagactattttaaagactaattgcttgacagtttctagggtattttgtgttttagaagcaaaaaaagaaaaaaaaataggtcaaaccagtaaacctcattttttttcaaactaataatttggggaaataaaaactattgtttaaaaaagaaatatatatatatatatataaatatatatgtaaagttaaaattccataccttgtatgtcaggtttgctaagtgtaatgtagtttttttaaggctcaaataccatacctcagaaaatgaggtttactatggaaatactgaaacagtctttgcagctgtgtgacaagtcactctactacatactgatttggagacctccgctaaatagttttatcactgcagactaaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgacataaaaagtttgct

SEQ ID NO: 141943 - DNA, 1780 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000431520
  CDS Start-End: 1-720
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgatagttagagctgattccacattagtctgtaggctgcctaaaagaatgaattggttatttgaatattttcatctcagatcgggtaacacggagaaaatttgcaacaatatagaagacatctgttgtttttgcctgcctgacatcccttcctccttctcttgataacaagagtgcccatttacctttagagaactttccttacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 141944 - DNA, 567 bp, Homo sapiens
  Payload ID: 7910
  Gene Symbol: IKZF2
  Gene Name: IKAROS family zinc finger 2 (Helios)
  ENST ID: ENST00000452786
  CDS Start-End: 318-567
gacatgaatgtctttctcagtctattccccaggacccctcttatcccgcttcaggtcccggtcaatgcggtgcgctttccgaaatggggccgcagagttgccggcggagaccagtaggtgggaggctccacgcacactccccgactcggccgggacgcggctcccggactccgcgcagggcgccaagatcgccgccccgctcccttcccccggcctccccaccaatcccagtttgaaagaaaacttcacgcggccgaaatgaacgtcacctcaccgctccaagcctccagccggcagaaaaccattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccc

SEQ ID NO: 141945 - DNA, 602 bp, Homo sapiens
  Payload ID: 7910
  Gene Symbol: IKZF2
  Gene Name: IKAROS family zinc finger 2 (Helios)
  ENST ID: ENST00000433134
  CDS Start-End: 226-602
gtttgctggatttgggcttggaatgacccacctgtaaagtgcttttccttcctcctccccttgaactctgcagggggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtgg

SEQ ID NO: 141946 - DNA, 9350 bp, Homo sapiens
  Payload ID: 7910
  Gene Symbol: IKZF2
  Gene Name: IKAROS family zinc finger 2 (Helios)
  ENST ID: ENST00000457361
  CDS Start-End: 446-1681
aaccctgctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattatttttgggaaaatgtccaaactgccccctttaaatctaagggaatgcaccaaaacagagatatatagaatgtcaaccatttcatttttttttttctgcatgccttggtacatagtgaacatacaacctatttaaagataaagcatgtttttgagactcgctcacccccccccacccaaccactcccaaataataattgggatgccattttttttccttttggatgaggtaaataattttaaggttcacaattttgtcttttactgcaatttaaggaaacatttggatgtcagtcaatatgttcataattttggctgtgtgcgaatttctgctggcattatctatgaattttcttcctacttatttttttttcagtatatgaacaatcatgtatctacctgccccaggatgaaactaaatttaggtggaccctaaaccttatgaagacagtgctgaggcactttccttttctgatttcatctttttgggaatctgttttattgaaggtagttagtagttgagagtgcatttgctacaagcatatacttgtatcttcctagcttcatgaggaacagaaagaggtggatatggctcagggtgtggcagggacaattgaggacaaagtcaattcaaatttgtgggtcagaaagaatttttgtggacgtagtgtttttggagaaactctggatggttatatgtgcatgccttttcttcaaaaggaaatacgcaaggttgtagcatctaaaaataaacataagagtcagacaccaaataaatcaagttttacataacagttgtatgcccagtttgtttaggtgagatttcacattacagaaagtatttgaggagcatgaaaatgggttatcttctgtattttccagtttggcaaaagttcagaatttcatcacattgctttgccctaattttgcccagaattttatcttagcctctctctgacagtgatgaatcatgctcaaaagccattctaattggacctttttaagacagggaaagggatcagtaggcggattggaagaaatttcaagtcattgaaatattccattgagatttcctaaagggacaaaattgggaaaataagaaactacgacttagatttggctacgtagtagaaagtatctcccctacatacatacaggcaattgtatgtatgaatcatagggtatatgtgtgtgtatactacacacacattcttttaaagagaattcatggaaaaaaaagcagttggagtgatcagatgtattgcaaaaacatacagagaatttaaatgacagttaataccaagaaattagttgggtttactttatcaggtcgtaataggaatcactaaagaagttactagtgtgtctttaggaccagtggcaactcttaaactaaaactttgggtccttattatctacttacagaacaaagtgaaacaaacaatgattaagctgattggatatacattcaaagatatttaatgtaaagttttttggaatacgaagaaaattcagaaaataaatattatcaacagttacttattggcaaatagagaaagacaagaatagtttagtgagcccggtattttgtttttatagtttttatctcagttgtacaactcacaaaaccatgaagtctttggtattttataaatgtttaacaaaatttacatcagattaaggcatttagatgaaaattattatgttctcactatcttccaaattttatttcatcctatctccaaaatgatttcttagggtacaaaaagagcagacggggctgtaaaaatacaagcaaaaaactgtgtgcccctagtttcaggcagaacttaaactgtcagaggtactagctacatgatttgttttttaactttggattgttcacgtccaaaaatggataaattacatttgtgtttatcatcagttgcattttatgtattattttaataaatactatctgaatgaagactattctaaaccagaaaattccccaaatccaaaagaaaaaaaaagtgggaagaggtgaaattgaagtttgtgtatatgaaagttatcttagacatatttttaattctccagtttctgcaaaataattaaaatatacagtaactggtctcctaaatcctgaatttaatgtattaaatacttatgttctttatattggtgcctttttaaaatgcattgagagtgttggttagctgttgcagctgtacaacacttttaatatgcatttttaaaaatcacttaaaattgagtactatataattcatctctgcatttttagtgcaaatctttagagcaatttctaatagagaaattttcagctcagctgttaaaaggaaaaggaaactttgaaactagactttactacctttttagtttcatagtatttctgaatatgattacaagattatgcaggtaaaatatagagtgaaactttacctgtgaattgaattataatttgtgtttttgttttgtttttaaggaagaataagttctgtatcaaacaagaatttattagataattttttggtcaataaaatacagtattcatttggattttcatctccagactagtattgttctagtcttggaatctgtattttctaatctgttagaaaatagagattgaaaattgatggaataatgtgaaaaagcaggtaattaattctccttgaacaaagcaaaactgaacagtcatatcacattgctattctccaaagcataatctcaaatggtttcatatcatggttgtgtattacttgcaatgggtgtgttaggatatgacagctttttaaaaaaatgagctgctggttatacaaagcaaatggcatatgaccaagaagctgtgatatgctagtgtttctttttatcatagtgtattactaggccaaataatgacaccttgaatatttttacatttattgcagaaaccttaaactttggaatttccataaggtttttatgtaatattctatttctagctttttagttttatcttgctgtactgtaagtttgaggatatttttcacctgcactcttaggaataagttcataattctgtttatggggctttcctcccataacactgcatttgtatattttctgtataaaatatgtgttgtgtattaacctttatcccatacagagagtggtacatgaatgactagttttctaagatgtcctttttattgtgaataaaatataaaagttaaaggccctctgctaagtcacataaagtacagcatataagttcatataggtacaaataaatgagtttgcagtgaattgggccttcaaattacctcaagtgacagatagtaagaaaagcttcttgagcaggtggaggtcactgaatcccctactatgcacttaccaagattttacttactttaatttactggaaattgattttttaaaaaatgactacactgtaacaagggaagggatctgggtttttttgttgttttattcttgttttttttaagtagttcaaattctgaaactgtgatttaaaaattttttacagtcaagcattctgattttgaacataactcccttccctttctgtgtaacaaaggtctctctgttatctcttaaattttgttacatctccctcagcctctttctttgtccgtctcccttctgtcattgtctatggatgtttacctctctgttctcctaaaagtttgaagattaggtcaactcttatttctagttcattggtaatttaatcttaatttttttttcgtgatttttgttggttgtataatctgctgacgtatttttatactcaagtgtagttttctattaaaaagaaaagtggttggattaaaaatagtaagctatgtaaccctcatgttactttcactttcaaatattgggtacctaaaacattacttcagagattatgtaatcctattatagtatgtttgctttcctttattgttggattttacattctgatttggctttcctccaaaaaatgtatatcatgaaagactagacagttatttgcaagtgtttagaaaggtgttaaaaatgtaaagcaaagagtcttaactttctcctaattgggagaaaaatgctttaacattactataataatattccaggtttggagggggtctccaggccccatatttgctgttaatagttggaccttttagaccatgtgttatttgcaatcccagaatgattgcttctgctattagttaaaaagatactattcttttctttctgtacaagtgcaatactccccttgaagtcttaaaaactatggtgatttttttttcttttctgacctattcttcctttagctaatgacaaaaagaaactcataaaagtcatagtatgttaaaggacacaacaagcaaagagaaaaacactccacaatcaaaagattacagaatgtggaaaccactagtctgatctcatggtatctttatttaagctaaatttccatggaaattagtaatcttttgcttgaaaaatgtgtcctaaagttgaactttttacagattgaatcttcttagaccctcgcccaatgctctaaattaagaacctaatacttaatatttttattttacttctccccttttagaaataaacttttaaataaaagcaaagcacttagctgagttttaaacacttacatatcacctattggagaaattttttttaaaaatatttggagcagtcctgttttcatacaaatttaagtaagaggtatttttcttatacatatttatatgtagtgtgctaattttctttttttatacctgtgtccctgtagtaaaactgctgtaatataaatacatgttttgttaaaagataacatttctttggcatttcttttaaaggcagttactgcatttctgcatttgtacagtatgtgtcttggccattttagatattctttctttaacaataccaaaggtaattagactattttaaagactaattgcttgacagtttctagggtattttgtgttttagaagcaaaaaaagaaaaaaaaataggtcaaaccagtaaacctcattttttttcaaactaataatttggggaaataaaaactattgtttaaaaaagaaatatatatatatatatataaatatatatgtaaagttaaaattccataccttgtatgtcaggtttgctaagtgtaatgtagtttttttaaggctcaaataccatacctcagaaaatgaggtttactatggaaatactgaaacagtctttgcagctgtgtgacaagtcactctactacatactgatttggagacctccgctaaatagttttatcactgcagactaaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgacataaaaagtttgct

SEQ ID NO: 141947 - DNA, 1594 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000453575
  CDS Start-End: 1-159
atggaaacagaggctattgatggctatataacgtgtgacaatgagctttcacccgaaagggagcactccaatatggcaattgacctcacctcaagcacacccaatggacagcatgcctcaccaagtcacatgacaagcaggtctttttcaaaaatatagaattagaagtgtcctttgatatacttctgttccttgccagattacattcaaccattaatttaagcaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggcctttt

SEQ ID NO: 141948 - DNA, 3888 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000434687
  CDS Start-End: 311-1891
gctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattat

SEQ ID NO: 141949 - DNA, 1737 bp, Homo sapiens
  Payload ID: 7910
  Gene Symbol: IKZF2
  Gene Name: IKAROS family zinc finger 2 (Helios)
  Uniprot ID: Q9UKS7
  ENST ID: ENST00000412444
  CDS Start-End: 1-159
atggaaacagaggctattgatggctatataacgtgtgacaatgagctttcacccgaaagggagcactccaatatggcaattgacctcacctcaagcacacccaatggacagcatgcctcaccaagtcacatgacaagcaggtctttttcaaaaatatagaattagaagtgtcctttgatatacttctgttccttgccagattacattcaaccattaatttaagtgtacctacctttgggccatgctccagtttgttgattgctgggataaccactggctagctctatatgctcaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggcc

SEQ ID NO: 141950 - DNA, 1296 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000346243
  CDS Start-End: 1-1296
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 141951 - DNA, 1413 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000350532
  CDS Start-End: 1-1413
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 141952 - DNA, 9667 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000346872
  CDS Start-End: 63-1592
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaacaaacaaaaaacagctacctaaaacttcttgaaagagttcatggagaattggtgatacagacccaaagcaaatttgccaatgatattttccacaaaaaaagtccaaaaagtatggctcagcctccccctccccacaggagaggaattggagatagatggcatgtgtgtttagatcggagttgagctccggaatggggtgaggagggacacctctattgagaggttctccttgatcaggcaggcttcggccctttttttcccatttaaatggaactgctgtattccatgaaaattcctgaaagtctgatcacggttctgcagatgtataagtcatccttgtcactcataatatgtacatactatcaggaggagtgctgttatcatggtaaaattagcactggaataggaggtcacaaaatgctggctaattagctatgtgactttgagaaatcgtttaactttttttttttttttttttttgagacaggatctcactctgttgcccaggctggagtgcagtggtgcaatcatggctcagtgcagcctcgacctccccaggctcaggtgatcctcccacctcagcctcttgagtactgggacaacaagtgcacaccaccatgtctggctacattttgttctttttgtagagataggggtctcactatgttgcccatgctggtcttgaactcctgggctcaagcaatcagcccgcctcagcctcctaaagtgctgggattacaggtgtgagccaccacacccagccttatttaactcttaaaactcagtttccggccaggctcggtggctcacacctgtaatcccaacactttgggaagccgaggcaggcgcatcatttgaggtcaggagttcgagaccagcctgacccacatggtgaaaccctgtctctactaaaaatacaaaaattagctgggcagtagtggcacatgcctgtaatcccagctactccggaggctgaggcagaaaaatcgcttaagcctgggaggttgaggttgcggtgagtggagatcacactactgcactccagtctgggcgacagagtgagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgctctgttgcccaggctggagtgcagtggcgcgatctcggctcacggcaacctccgcctcccgggttcaagcaattctcctgcctcagcctcccaagtagctgggattacaggtgctcaccaccaagcccggctaatttttgtatttttagtagagacaaggtttcaccatgttggccaggccagtctcaaactcctgacctcaggtgatctgcccgccttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaattccagaaaaaatttatgtgtggaaactctgcatccttaagtcttgaagttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatcacctgaggttgggagttcgagacctgcctgaccaacatggagaaacccccatctctactaaaaatacaaaattagccgggcgtgatggcacatgcctgtaatcccagctactcaggaggctgaggcaggagaatcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggaaagaaaactaaatagaagtgtctctcccgtgagcccccaccactaccaccagaaaaaaaaaagagagaaaatgaactcatcagtctttagtttcctcaagttattctcccaaaaagacattcgccttggcacagataagccagctaatcttatgctttatgacccactgtgagctgttcctgacacagcttctgactttgtcagtgacaaaatttctcaccttttaaatgcagtgcttaacattttgttaggcccatactcaaaatcggccagatataaaatgacctcagattttgatctcctaggctcaaacaatcctcctacctcagcctcccaagtagctgggactataggcacaccaccatgcacagctaattttttttgtatttttctgcagagatggcgtttcgccatactgcccaggctagtctcaaaatcctgggctcaagcaatctgcccacctcagcctcccaaagtgctggaactacaggcaagagccactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccaggaggaggaggttgtggtgagccgagatcgtgccattgcactccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaaaaaaaaaaaaaaagaatgttttaaggaaaaaaatagtactgttacatataatcccaggtgataagaccacaatggaaatgtttaagtcctcactttaaagagtaccccactgagaagaggtatgttggactctagcagagatttggaaactctgggacactcaagatgtgaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttctttttgagacaaagtctcgctctgtttccccaggctgagtgcagtggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaatta

SEQ ID NO: 141953 - DNA, 1413 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000351680
  CDS Start-End: 1-1413
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 141954 - DNA, 1669 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000377944
  CDS Start-End: 63-1163
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141955 - DNA, 1696 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000377945
  CDS Start-End: 63-1190
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141956 - DNA, 1435 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000377952
  CDS Start-End: 63-929
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggaggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141957 - DNA, 1837 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000377958
  CDS Start-End: 63-1331
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggaggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141958 - DNA, 1552 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000394189
  CDS Start-End: 63-1046
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141959 - DNA, 1246 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000439016
  CDS Start-End: 2-1246
catggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 141960 - DNA, 1879 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000439167
  CDS Start-End: 63-1373
gcaggagcacgtggagaggccgagtagccacagcggcagctccagcccggcccggcagcgacatggaagatatacaaacaaatgcggaactgaaaagcactcaggagcagtctgtgcccgcagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141961 - DNA, 1362 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000467757
  CDS Start-End: 1-1362
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 141962 - DNA, 1996 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000535189
  CDS Start-End: 63-1490
gcaggagcacgtggagaggccgagtagccacagcggcagctccagcccggcccggcagcgacatggaagatatacaaacaaatgcggaactgaaaagcactcaggagcagtctgtgcccgcagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141963 - DNA, 1456 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000583368
  CDS Start-End: 374-1162
ttttcaaaagtgctgttaacataaacagagcagtaaatctggggcaccatgcttttttttcaaagttgttaagaattatatcagtctgcaggtgtcacacgcagttactcagaatcagaaagaaggctgatcgggggttagatctccatctatctatctttttgcaaccaaccacgtccaggctgtttatttaatacttcctcttgctaatgaaggtactggttggggatgggtcgagctttcccatctcggcataagactgcaagatttgaatgtgccctggtgtcggcttcactgaccacagcaggtaccccaggcaagaatctgagcagttataacagcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagt

SEQ ID NO: 141964 - DNA, 2224 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000293068
  CDS Start-End: 63-854
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactggtactggttggggatgggtcgagctttcccatctcggcataagactgcaagatttgaatgtgccctggtgtcggcttcactgaccacagcaggtaccccaggcaagaatctgagcagttataacagcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141965 - DNA, 2056 bp, Homo sapiens
  Payload ID: 7911
  Gene Symbol: IKZF3
  Gene Name: IKAROS family zinc finger 3 (Aiolos)
  ENST ID: ENST00000348427
  CDS Start-End: 63-686
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactgtggagaaaccctacaaatgtgagttttgtggaaggagttacaagcagagaagttcccttgaggagcacaaggagcgctgccgtacatttcttcagagcactgacccaggggacactggtactggttggggatgggtcgagctttcccatctcggcataagactgcaagatttgaatgtgccctggtgtcggcttcactgaccacagcaggtaccccaggcaagaatctgagcagttataacagcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 141966 - DNA, 9787 bp, Homo sapiens
  Payload ID: 7911
  Gene Symbol: IKZF3
  Gene Name: IKAROS family zinc finger 3 (Aiolos)
  Uniprot ID: Q9UKT9
  ENST ID: ENST00000623724
  CDS Start-End: 930-1718
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactggtactggttggggatgggtcgagctttcccatctcggcataagactgcaagatttgaatgtgccctggtgtcggcttcactgaccacagcaggtaccccaggcaagaatctgagcagttataacagcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaacaaacaaaaaacagctacctaaaacttcttgaaagagttcatggagaattggtgatacagacccaaagcaaatttgccaatgatattttccacaaaaaaagtccaaaaagtatggctcagcctccccctccccacaggagaggaattggagatagatggcatgtgtgtttagatcggagttgagctccggaatggggtgaggagggacacctctattgagaggttctccttgatcaggcaggcttcggccctttttttcccatttaaatggaactgctgtattccatgaaaattcctgaaagtctgatcacggttctgcagatgtataagtcatccttgtcactcataatatgtacatactatcaggaggagtgctgttatcatggtaaaattagcactggaataggaggtcacaaaatgctggctaattagctatgtgactttgagaaatcgtttaactttttttttttttttttttttgagacaggatctcactctgttgcccaggctggagtgcagtggtgcaatcatggctcagtgcagcctcgacctccccaggctcaggtgatcctcccacctcagcctcttgagtactgggacaacaagtgcacaccaccatgtctggctacattttgttctttttgtagagataggggtctcactatgttgcccatgctggtcttgaactcctgggctcaagcaatcagcccgcctcagcctcctaaagtgctgggattacaggtgtgagccaccacacccagccttatttaactcttaaaactcagtttccggccaggctcggtggctcacacctgtaatcccaacactttgggaagccgaggcaggcgcatcatttgaggtcaggagttcgagaccagcctgacccacatggtgaaaccctgtctctactaaaaatacaaaaattagctgggcagtagtggcacatgcctgtaatcccagctactccggaggctgaggcagaaaaatcgcttaagcctgggaggttgaggttgcggtgagtggagatcacactactgcactccagtctgggcgacagagtgagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgctctgttgcccaggctggagtgcagtggcgcgatctcggctcacggcaacctccgcctcccgggttcaagcaattctcctgcctcagcctcccaagtagctgggattacaggtgctcaccaccaagcccggctaatttttgtatttttagtagagacaaggtttcaccatgttggccaggccagtctcaaactcctgacctcaggtgatctgcccgccttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaattccagaaaaaatttatgtgtggaaactctgcatccttaagtcttgaagttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatcacctgaggttgggagttcgagacctgcctgaccaacatggagaaacccccatctctactaaaaatacaaaattagccgggcgtgatggcacatgcctgtaatcccagctactcaggaggctgaggcaggagaatcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggaaagaaaactaaatagaagtgtctctcccgtgagcccccaccactaccaccagaaaaaaaaaagagagaaaatgaactcatcagtctttagtttcctcaagttattctcccaaaaagacattcgccttggcacagataagccagctaatcttatgctttatgacccactgtgagctgttcctgacacagcttctgactttgtcagtgacaaaatttctcaccttttaaatgcagtgcttaacattttgttaggcccatactcaaaatcggccagatataaaatgacctcagattttgatctcctaggctcaaacaatcctcctacctcagcctcccaagtagctgggactataggcacaccaccatgcacagctaattttttttgtatttttctgcagagatggcgtttcgccatactgcccaggctagtctcaaaatcctgggctcaagcaatctgcccacctcagcctcccaaagtgctggaactacaggcaagagccactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccaggaggaggaggttgtggtgagccgagatcgtgccattgcactccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaaaaaaaaaaaaaaagaatgttttaaggaaaaaaatagtactgttacatataatcccaggtgataagaccacaatggaaatgtttaagtcctcactttaaagagtaccccactgagaagaggtatgttggactctagcagagatttggaaactctgggacactcaagatgtgaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttctttttgagacaaagtctcgctctgtttccccaggctgagtgcagtggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttg

SEQ ID NO: 141967 - DNA, 5229 bp, Homo sapiens
  Payload ID: 7912
  Gene Symbol: IKZF4
  Gene Name: IKAROS family zinc finger 4 (Eos)
  Uniprot ID: Q9H2S9
  ENST ID: ENST00000262032
  CDS Start-End: 368-2125
cctcgcctccctctcccccaacactgtcccctctccccaacccctcacagcctgcgcgcgcgcggagacacctcagtctacatggggaggacagagaagcgcaaagaacaagagaaaagatgcatccatctgagatctaaaaggagacaatgagaatctctttaaaatggacatagaagactgcaatggccgctcctatgtgtctgtaggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacc

SEQ ID NO: 141968 - DNA, 5021 bp, Homo sapiens
  Payload ID: 7912
  Gene Symbol: IKZF4
  Gene Name: IKAROS family zinc finger 4 (Eos)
  Uniprot ID: Q9H2S9
  ENST ID: ENST00000431367
  CDS Start-End: 160-1917
ggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacc

SEQ ID NO: 141969 - DNA, 2539 bp, Homo sapiens
  Payload ID: 7912
  Gene Symbol: IKZF4
  Gene Name: IKAROS family zinc finger 4 (Eos)
  Uniprot ID: Q9H2S9
  ENST ID: ENST00000547167
  CDS Start-End: 415-2172
ctctttgtctgctgggcacgaggggcaacagcatctgcctttccctccctgtgcacacacccaccacccacccccttcactgtcttggaaaagggatgctgtagcctagcatctcccccactatatacacatatacattctctccagccccctccccaagcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctctt

SEQ ID NO: 141970 - DNA, 420 bp, Homo sapiens
  Payload ID: 7912
  Gene Symbol: IKZF4
  Gene Name: IKAROS family zinc finger 4 (Eos)
  ENST ID: ENST00000552689
  CDS Start-End: 391-420
tggccattcctaggatgacctgggaatttatcccctctgcactgctccccaagcacttggataatgaagctgagctgtcttcaactgtattatatgtagacagaaggtcaccatctacagcctggtgaaaaatgagtcagacctttccactgtaaagacaaacacatgagctgagctaagaatctctttaaaatggacatagaagactgcaatggccgctcctatgtgtctggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgt

SEQ ID NO: 141971 - DNA, 3683 bp, Homo sapiens
  Payload ID: 7912
  Gene Symbol: IKZF4
  Gene Name: IKAROS family zinc finger 4 (Eos)
  ENST ID: ENST00000551103
  CDS Start-End: 447-593
cttgcctctctcaggcatttgttgtgcagttcctctttgtctgctgggcacgaggggcaacagcatctgcctttccctccctgtgcacacacccaccacccacccccttcactgtcttggaaaagggatgctgtagcctagcatctcccccactatatacacatatacattctctccagccccctccccaagcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatgtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgttt

SEQ ID NO: 141972 - DNA, 1712 bp, Homo sapiens
  Payload ID: 7912
  Gene Symbol: IKZF4
  Gene Name: IKAROS family zinc finger 4 (Eos)
  ENST ID: ENST00000547791
  CDS Start-End: 90-1712
actcaacacacatacaccctgggctgagctgctcttgctggctgcagccgtgggcctctgctcaccgtgccgctgctgctgcctgcgaaatgacggcggttcccctcacttccaggaatccacgcttcctggaaggtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctag

SEQ ID NO: 141973 - DNA, 4555 bp, Homo sapiens
  Payload ID: 7913
  Gene Symbol: IKZF5
  Gene Name: IKAROS family zinc finger 5 (Pegasus)
  Uniprot ID: Q9H5V7
  ENST ID: ENST00000368886
  CDS Start-End: 322-1581
gggcgggaagggagtcggagacacaacaaagatggcggcggcgactgtgacggtgacgaagacggcggcggcggcgacggcatttaacaaggcggtgtggtttactccatgcagttgtcaggagacctctgtatggcttttcaattttagttgaaattctctctccatggccttttggagtcccttgctgtatctccgaagtaaatttcaattactctacatttcatcaatgttggagtggcaagaaaaaggaggaacagatttggggtgaaaagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttctgccatatttcaaaatggtagaataaattacagaatttattactactcatttcagtgtttagtacagaaattgccttaaaaattgctattaattgaaatatcatttagttcacattccttaagttgaatcggtagtttcatttcaactgataatagtaaagctatttcagtttagtaaaaattttcttttttccacaagaggaaatgtaaaacagttaagacttgaaattgaaaattcttttaatatttaaaataacttgtttattcaatgtctaaacacatgtcagttttccactggatttttattttcacaggtaaatacactagagtgctagatgcctttttcccctgtcagtttgactttcatttaaatccttcattctgatatcattactgttaggtgaggtggataactataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaatgcatttttttctaacaactgaccatggatgttgtgaaggtgcattttaatttaaacatggaaaagatttttttcataattacatactagaatgtaaaattataattttgccatgacttaaagagcacagttgatatcccaaaggttttgatgctaagaagctacagttattctaaatgcactaaaatgtttgaggcaaatctaccttagaggcttttttggtatggtattttttaaaatatttagattttatttaaatttcctgtgagttattctgtatttgaaaagatgttcgtgtcttcccctctgtattgaatgtttcactcattttatttttaatcaaatattttatagaaatgagttgttgggaagagtttaacatgcactatttatagtactttgccgttaacaggcaatgttctgaaactaaatttatttttgttcagtgaacataagtttagatttttaaagttggtagataatttatctccactaatatttttttaagaaactgtgaagagattaactgggaataattttatttcagattttactaatgtagtatgtagctacaacttcttgaacttcaagttaaggctagacatttactttgaaaaaattccactgggtgtttccagggctatttcattttagaaataagtgtttgccattcttctgcaaaaactggacaaggggaatactacaaaaaatactcagagataaaatcctcatttcaagttctacaaaatatttatcaaatgaatgttaatttttttttaattccctgctaaagacgttttcattagtcttagagggtatatgctttctagaacttgtttttgttaacatgtgctttgatgtaaagaacatattttgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatgac

SEQ ID NO: 141974 - DNA, 4542 bp, Homo sapiens
  Payload ID: 7913
  Gene Symbol: IKZF5
  Gene Name: IKAROS family zinc finger 5 (Pegasus)
  Uniprot ID: Q9H5V7
  ENST ID: ENST00000617859
  CDS Start-End: 311-1570
agcaggctgccggctcggacggcggcgacgcggcaggacagggcggataagaaggagcggccggagactggagctgggttcgtggcgggccggctgatccggacggagactcaacctctgtatggcttttcaattttagttgaaattctctctccatggccttttggagtcccttgctgtatctccgaagtaaatttcaattactctacatttcatcaatgttggagtggcaagaaaaaggaggaacagatttggggtgaaaagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttctgccatatttcaaaatggtagaataaattacagaatttattactactcatttcagtgtttagtacagaaattgccttaaaaattgctattaattgaaatatcatttagttcacattccttaagttgaatcggtagtttcatttcaactgataatagtaaagctatttcagtttagtaaaaattttcttttttccacaagaggaaatgtaaaacagttaagacttgaaattgaaaattcttttaatatttaaaataacttgtttattcaatgtctaaacacatgtcagttttccactggatttttattttcacaggtaaatacactagagtgctagatgcctttttcccctgtcagtttgactttcatttaaatccttcattctgatatcattactgttaggtgaggtggataactataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaatgcatttttttctaacaactgaccatggatgttgtgaaggtgcattttaatttaaacatggaaaagatttttttcataattacatactagaatgtaaaattataattttgccatgacttaaagagcacagttgatatcccaaaggttttgatgctaagaagctacagttattctaaatgcactaaaatgtttgaggcaaatctaccttagaggcttttttggtatggtattttttaaaatatttagattttatttaaatttcctgtgagttattctgtatttgaaaagatgttcgtgtcttcccctctgtattgaatgtttcactcattttatttttaatcaaatattttatagaaatgagttgttgggaagagtttaacatgcactatttatagtactttgccgttaacaggcaatgttctgaaactaaatttatttttgttcagtgaacataagtttagatttttaaagttggtagataatttatctccactaatatttttttaagaaactgtgaagagattaactgggaataattttatttcagattttactaatgtagtatgtagctacaacttcttgaacttcaagttaaggctagacatttactttgaaaaaattccactgggtgtttccagggctatttcattttagaaataagtgtttgccattcttctgcaaaaactggacaaggggaatactacaaaaaatactcagagataaaatcctcatttcaagttctacaaaatatttatcaaatgaatgttaatttttttttaattccctgctaaagacgttttcattagtcttagagggtatatgctttctagaacttgtttttgttaacatgtgctttgatgtaaagaacatattttgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatg

SEQ ID NO: 141975 - DNA, 3189 bp, Homo sapiens
  Payload ID: 7914
  Gene Symbol: IKBIP
  Gene Name: IKBKB interacting protein
  Uniprot ID: Q70UQ0
  ENST ID: ENST00000299157
  CDS Start-End: 375-1508
ggactcgggcagcggcggcgcgcccgacgtggcgcgcgcgaccccttcgtcctgcccctcctcctcgggtcccgtcggcctgcgcgcgcccgggagtttgaatttcctcggatttggagcaatatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagcttgagtctactgaaagcatcctgcaggaagctacatcatccatgtctttgatgacccagtttgagcaggaagtatccaacctccaagatatcatgcatgacattcaaaataatgaagaggtgctcactcaaaggatgcaaagccttaatgagaaatttcagaatattacggatttctggaagagaagcctagaagaaatgaacattaatacagacattttcaaatcagaagcaaaacatatacattctcaagtaactgtccaaattaactcagctgagcaggaaataaaattgctcactgaacggctaaaagatttggaagatagcacactaagaaatattagaacagtaaaaagacaagaagaagaagatctcctgcgagtagaggagcagctaggctctgatacaaaggcaattgaaaagttagaagaggaacagcatgccctctttgccagagatgaagatctgactaataaactttccgactacgaacccaaagttgaagaatgcaagacacatttgccaacaattgaaagtgctattcactctgttctcagagtctctcaggatctgatagaaacagaaaagaaaatggaagacttgactatgcagatgtttaatatggaagatgatatgctgaaagcagtgtctgaaataatggagatgcagaaaacccttgaaggaattcagtatgataatagcatattaaagatgcaaaatgaactggatattctaaaagaaaaagttcatgattttatagcatactcaagtacaggagaaaagggaactttaaaagaatataatatagaaaataaaggaattggtggtgatttttaaattcatgacatttattctgatgaaccatatcattatacataaattgattagtccattgattttgagttactttgatacgcctcatcttatcctacattattggaaaataaatgagatgtccacacaaatggattatccacataatcaaagcttatctttttaagcactaaaacttacttcattgtaactatttgaaatagaaatagttctttaaaaatatttctctacttttaaaacaagatacttaatatttttaatgttttttaaagcattaatgaacatcatcattaatttcacctattatattgtacccacatatattgatgtctccaggggctaataaagagtatttaccacttcactaaatgaccccaatttgccattttcaaacctatgtctcataccttttctgtcacctgaacttactgtcaggttggttggtaatgtgcctgcctcagccagttcactttcttaggtaattcactgcaggttaagaatccacacaaccaagttcatgggaattttgtgtaaaataaaagataacatgcctgagggagagcctggtgcctttgctatgaattaatatgcactttctgaaaactctaaagcctgggaaacattttagtttttgttaaggttctaaactgtgttacagatacttgtaagacttttaaaatcagagtaagtatgttcttacataaggcctttcttaggaattatgtgtatataaatctttgaaatatctttatatacctgagttttaggttccaactgtgttagacatgagtttgctagatccatggtctctagatggtttacttaaataggccaggcgcagtggctcacacctgtaatcctagcactttgggaggccgaggtgggcagatcacgaagtcaggagatcaagaccatctggctaacagggtgaaaccctgtctctactaaaaaatacaaaaaattagccaggcgtggtggtgggtgcctgtagtcccagctactcaggaggctgaggcaggagaatggtgtgaacccgggaggcagagcttgcagtgagccgagatcgcgccactgcactccagcctgagtggcaaagtgagactctgtctcaataaataaataaataaataaaaataagcctgtggcctgttttgagggaaaagtaacataactctgataattaattatgataataactatgatagttaaaaatacgtcattttaaagatttcccaaaccacaccactaaatttgttttatgaattgattttattttatttgaaattatataatgtagtcaactgcaatatggaagtttgttcttgtttctttgtcaataaccttaccagttttataatgcagtttttgatggaattaaacacaaagaacttgaaagcagtcagttacaaaaaggtagttgtggtcaagtagttttaatatgtaaatttgcaagtttttggagaacccccaaactccttctccactggagttaggagggcctgtggtagacagcgtgaatcatgaaaataagcctggagagttctgttattaaggggcatagcattaatttttgcagtcttaaaattacacttcttgacttctgaatgtctcttatttgcgtgcactgacaaaattctatttgtttacttttatattaatggtaataaaatagattataaagtaa

SEQ ID NO: 141976 - DNA, 1645 bp, Homo sapiens
  Payload ID: 7914
  Gene Symbol: IKBIP
  Gene Name: IKBKB interacting protein
  Uniprot ID: Q70UQ0
  ENST ID: ENST00000342502
  CDS Start-End: 413-1465
gctaagcctcagggacgcgccgcgttcccaccaatgccggactcgggcagcggcggcgcgcccgacgtggcgcgcgcgaccccttcgtcctgcccctcctcctcgggtcccgtcggcctgcgcgcgcccgggagtttgaatttcctcggatttggagcaatatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacct

SEQ ID NO: 141977 - DNA, 1368 bp, Homo sapiens
  Payload ID: 7914
  Gene Symbol: IKBIP
  Gene Name: IKBKB interacting protein
  Uniprot ID: Q70UQ0
  ENST ID: ENST00000393042
  CDS Start-End: 254-466
atatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctgtggcagaaatctgaagctatcatggaacaattgaagtcttttcaaataattgctcatctaaagcgtctacaggaagaaattaatgaggtaaaaacttggtccaataggataactgaaaaacaggatatactgaacaacagtctgacgacgctttctcaagacattacaaaagtagaccaaagtacaacttccatggcaaaagatgttggtctcaagattacaagtgtaaaaacagatatacgacggatttcaggtttagtaactgatgtaatatcattgacagattctgtgcaagaactagaaaataaaatagagaaagtagaaaaaaatacagtaaaaaatataggtgatcttctttcaagcagtattgatcgaacagcaacgctccgaaagacagcatctgaaaattcacaaagaattaactctgttaagaagacgctaaccgaactaaagagtgacttcgacaaacatacagatagatttctaagcttagaaggtgacagagccaaagttctgaagacagtgacttttgcaaatgatctaaaaccaaaggtgtataatctaaagaaggacttttcccgtttagaaccattagtaaatgatttaacactacgcattgggagattggttaccgacttactacaaagagagaaagaaattgctttcttaagtgaaaaaatatctaatttaacaatagtccaagctgagattaaggatattaaagatgaaatagcacacatttcagatatgaattagtttgacattattgagattagactaaggtaatttttttaatgggacctctcatgagaagactggtaaatcaaaaataatgatattttggagcaaaagtcattttatatttaatcctattttgtacagtaaaaataaaactttaaaacaggttgattttccaaaataaatatgctaaaacct

SEQ ID NO: 141978 - DNA, 4528 bp, Homo sapiens
  Payload ID: 7915
  Gene Symbol: ITK
  Gene Name: IL2-inducible T-cell kinase
  Uniprot ID: Q08881
  ENST ID: ENST00000422843
  CDS Start-End: 153-2015
gttgatagaaagataacgttgaaggcaagttgcccttgagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcctcgg

SEQ ID NO: 141979 - DNA, 571 bp, Homo sapiens
  Payload ID: 7915
  Gene Symbol: ITK
  Gene Name: IL2-inducible T-cell kinase
  ENST ID: ENST00000521769
  CDS Start-End: 351-571
cctttaacgaaattctagctccgcctcagaccgatccctcgctgttgcgcctacgtcccccatggaggttttgaacgcactcattgaagagtagctgtgggctgtgtaataagaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactg

SEQ ID NO: 141980 - DNA, 587 bp, Homo sapiens
  Payload ID: 7915
  Gene Symbol: ITK
  Gene Name: IL2-inducible T-cell kinase
  ENST ID: ENST00000517779
  CDS Start-End: 112-462
agctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaaaggggtctcgctatgttgcctaggctaatctagaactcctggactcaagtgatcctcttgcctcggcctacgaaagtactgggattacaagcatgagccactacacccaactctgttctgtgccttataaacgaggaataataacagt

SEQ ID NO: 141981 - DNA, 2304 bp, Homo sapiens
  Payload ID: 7916
  Gene Symbol: ILVBL
  Gene Name: ilvB (bacterial acetolactate synthase)-like
  Uniprot ID: A1L0T0
  ENST ID: ENST00000263383
  CDS Start-End: 141-2039
tgcgcatcgggccggactacggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 141982 - DNA, 788 bp, Homo sapiens
  Payload ID: 7916
  Gene Symbol: ILVBL
  Gene Name: ilvB (bacterial acetolactate synthase)-like
  ENST ID: ENST00000533747
  CDS Start-End: 291-788
gaaggtgaatagcgtcgggggtcgagctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctg

SEQ ID NO: 141983 - DNA, 1309 bp, Homo sapiens
  Payload ID: 7916
  Gene Symbol: ILVBL
  Gene Name: ilvB (bacterial acetolactate synthase)-like
  ENST ID: ENST00000533148
  CDS Start-End: 265-423
ctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaagggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggcccc

SEQ ID NO: 141984 - DNA, 1090 bp, Homo sapiens
  Payload ID: 7916
  Gene Symbol: ILVBL
  Gene Name: ilvB (bacterial acetolactate synthase)-like
  ENST ID: ENST00000527093
  CDS Start-End: 304-1090
gtgtggtgctgtcgtcgccaccttgacttgtggtggctagtttgggtgggagtggtggtgatgtaaaggactggggctagccccgcgaggggcgtgaccttgtcacggagaggcatggcttcaccccgagcctaggcgcacaaagggcgtggtctggcagggttgggggcgtggccgcacagaaactggcggcaagggtcgtggccctggatcctgctgcgagaaggggcgcgatttcttccggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccc

SEQ ID NO: 141985 - DNA, 747 bp, Homo sapiens
  Payload ID: 7916
  Gene Symbol: ILVBL
  Gene Name: ilvB (bacterial acetolactate synthase)-like
  ENST ID: ENST00000598709
  CDS Start-End: 59-747
tggaggtgaaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaaccc

SEQ ID NO: 141986 - DNA, 2067 bp, Homo sapiens
  Payload ID: 7916
  Gene Symbol: ILVBL
  Gene Name: ilvB (bacterial acetolactate synthase)-like
  ENST ID: ENST00000534378
  CDS Start-End: 254-1831
tcccgggtcacgtgacacggagggggccgaattctgctggaggcagcgccatatcctggaggtgaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataa

SEQ ID NO: 141987 - DNA, 709 bp, Homo sapiens
  Payload ID: 7916
  Gene Symbol: ILVBL
  Gene Name: ilvB (bacterial acetolactate synthase)-like
  ENST ID: ENST00000600984
  CDS Start-End: 213-709
tctgggaagtgccctttctctcttaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggt

SEQ ID NO: 141988 - DNA, 890 bp, Homo sapiens
  Payload ID: 7917
  Gene Symbol: ICT1
  Gene Name: immature colon carcinoma transcript 1
  Uniprot ID: Q14197
  ENST ID: ENST00000301585
  CDS Start-End: 14-634
gcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgggaaaggctgagacaaaagagaattcattctgctgtaaagacaagcaggagggtcgacatggactgaaatcaccctctgcagctgggagggctcttctgggcgtccgggcagctgcagctgagaggactttcacaccataaggagatttctgtttttctttttggctgttaatgcttgtctataacattggagccatcacaagaatgttcatttggaatgaaggctgcaggcactggttgcagacgtctttataggcagtcaccatgttgtcaaaccttaataatgcacctcatgtattagtcacaataaaaatcagaactca

SEQ ID NO: 141989 - DNA, 593 bp, Homo sapiens
  Payload ID: 7917
  Gene Symbol: ICT1
  Gene Name: immature colon carcinoma transcript 1
  ENST ID: ENST00000584208
  CDS Start-End: 18-593
agtcgcaagacctgagcatggcggccaccaggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgtttttcatttgttctctgcagcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcatagaatcaggatagaaaacatgaatcgg

SEQ ID NO: 141990 - DNA, 513 bp, Homo sapiens
  Payload ID: 7917
  Gene Symbol: ICT1
  Gene Name: immature colon carcinoma transcript 1
  ENST ID: ENST00000580800
  CDS Start-End: 1-214
gctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagagagatatctatatctgaaaggaacaccctggatacagtgactgcctggaggaatagagagataagacaaacttggtggctgagagacaagagtgaaagacatttccatatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgc

SEQ ID NO: 141991 - DNA, 2085 bp, Homo sapiens
  Payload ID: 7918
  Gene Symbol: IER2
  Gene Name: immediate early response 2
  Uniprot ID: Q9BTL4
  ENST ID: ENST00000292433
  CDS Start-End: 364-1035
gggggcggtgtcggagttctgtctgggcctattcgggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 141992 - DNA, 2934 bp, Homo sapiens
  Payload ID: 7918
  Gene Symbol: IER2
  Gene Name: immediate early response 2
  Uniprot ID: Q9BTL4
  ENST ID: ENST00000588173
  CDS Start-End: 1213-1884
gggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 141993 - DNA, 1291 bp, Homo sapiens
  Payload ID: 7918
  Gene Symbol: IER2
  Gene Name: immediate early response 2
  Uniprot ID: Q9BTL4
  ENST ID: ENST00000587885
  CDS Start-End: 229-900
ctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcat

SEQ ID NO: 141994 - DNA, 1244 bp, Homo sapiens
  Payload ID: 7919
  Gene Symbol: IER3
  Gene Name: immediate early response 3
  Uniprot ID: P46695
  ENST ID: ENST00000259874
  CDS Start-End: 37-507
gaccctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 141995 - DNA, 1350 bp, Homo sapiens
  Payload ID: 7919
  Gene Symbol: IER3
  Gene Name: immediate early response 3
  ENST ID: ENST00000376377
  CDS Start-End: 31-447
cacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtccgccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 141996 - DNA, 1244 bp, Homo sapiens
  Payload ID: 7919
  Gene Symbol: IER3
  Gene Name: immediate early response 3
  Uniprot ID: P46695
  ENST ID: ENST00000383560
  CDS Start-End: 37-507
gaccctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccctctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 141997 - DNA, 1350 bp, Homo sapiens
  Payload ID: 7919
  Gene Symbol: IER3
  Gene Name: immediate early response 3
  ENST ID: ENST00000400509
  CDS Start-End: 31-447
cacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccctctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 141998 - DNA, 1350 bp, Homo sapiens
  Payload ID: 7919
  Gene Symbol: IER3
  Gene Name: immediate early response 3
  ENST ID: ENST00000446599
  CDS Start-End: 31-447
cacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 141999 - DNA, 1244 bp, Homo sapiens
  Payload ID: 7919
  Gene Symbol: IER3
  Gene Name: immediate early response 3
  Uniprot ID: P46695
  ENST ID: ENST00000439190
  CDS Start-End: 37-507
gaccctcacttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgca

SEQ ID NO: 142000 - DNA, 1350 bp, Homo sapiens; identical to SEQ ID NO: 141998
  Payload ID: 7919
  Gene Symbol: IER3
  Gene Name: immediate early response 3
  ENST ID: ENST00000429592
  CDS Start-End: 31-447

SEQ ID NO: 142001 - DNA, 1244 bp, Homo sapiens; identical to SEQ ID NO: 141999
  Payload ID: 7919
  Gene Symbol: IER3
  Gene Name: immediate early response 3
  Uniprot ID: P46695
  ENST ID: ENST00000450236
  CDS Start-End: 37-507

SEQ ID NO: 142002 - DNA, 1244 bp, Homo sapiens; identical to SEQ ID NO: 141999
  Payload ID: 7919
  Gene Symbol: IER3
  Gene Name: immediate early response 3
  Uniprot ID: P46695
  ENST ID: ENST00000416884
  CDS Start-End: 37-507

SEQ ID NO: 142003 - DNA, 1350 bp, Homo sapiens; identical to SEQ ID NO: 141998
  Payload ID: 7919
  Gene Symbol: IER3
  Gene Name: immediate early response 3
  ENST ID: ENST00000416336
  CDS Start-End: 31-447

SEQ ID NO: 142004 - DNA, 1244 bp, Homo sapiens; identical to SEQ ID NO: 141999
  Payload ID: 7919
  Gene Symbol: IER3
  Gene Name: immediate early response 3
  Uniprot ID: P46695
  ENST ID: ENST00000435856
  CDS Start-End: 37-507

SEQ ID NO: 142005 - DNA, 1350 bp, Homo sapiens; identical to SEQ ID NO: 141998
  Payload ID: 7919
  Gene Symbol: IER3
  Gene Name: immediate early response 3
  ENST ID: ENST00000436988
  CDS Start-End: 31-447

SEQ ID NO: 142006 - DNA, 3525 bp, Homo sapiens
  Payload ID: 7920
  Gene Symbol: IER3IP1
  Gene Name: immediate early response 3 interacting protein 1
  Uniprot ID: Q9Y5U9
  ENST ID: ENST00000256433
  CDS Start-End: 98-346
atcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaagcacttgtttttgtaccttagtataaacctgtcagtgttaactgcattaatctccattttgggtgaacacctcttattatatgttctttgctgtaaaattgccgagtatagagttaatgaaagtaaatatttacatgtatttttttttcttcagtgaattaactgaattgctgacatacatccagaagactcatgagcaccttttatttcatgacttcagttacttctaaaactatggagcaggtattaagtaccttttggcctttcctaagttagagatcagtgatctttggactataggcttgcagctagtccaaggaaagtaccaaggattcttagttgattacttggctcatgtgaatgactaatttggtacttagaggccgtgttcttttagccttacaaagaactgatgcctgagttcaagtttgagctactgaaaagattcaaaagaagcagttacttgagggcaggcccatttccccatatggtatgagcagtacaaaattttttaaaatgaaagaaaagagagaccttgatctgatgttatttttcatataagacattacagcataccttcatcttaattcagtgttgggattttgtccaaatattccatcagggagcagtcacagaagggccaggatcaaagtattctgtagccaagtagttctgaggaaagtgaagcactgaactgaacatcaaaatatgtcatatctggaggccacttcataattccagtttgtggctgaagaggggtctgtaagctttcactggtcagccctggtttccccagagcagttgtgattcagtaaacagagtgtgttattttagtagacagtaacttaagtgcctgttggcctgcccatgtcctcccctttatctattaccaggattaacaatttgtgatgattctggactccaaataccgatgatgtttatagtccttatgtattctggccctgtgtttgcatgtctctgaactgtgcgaaggttcttggctctagtctgtagatattaaccaaattcatcgctaatcaagtacagtggttttcaaacttttatagttaacagcagaaccagattttcaaaggaattctgacacagaactgtaacattcccgtatctaaaccagatgagagtaggtccatttatttgtttttagttgaagtagagctgggattcaaaggctcactattcagcctccactgcactcttgtcaggcttcccaaggcatttccataaaaccctaaattttcaaaaatatagctaaaaagtatcttataaaaatccctgctttagccataaaaaagaattagataataccttctgtgggaacatggatggagctggaagccatcatccttaacaaactaatgtaggaacagaaaaccaaataccacatgttattacttataagtgggagctaaatgataagacctcatggacataaggagggggacaacagacactgggggctatttgagggtggagggtgagaaagagtgccagaaaaattactgggtactaggcttagcacctggataacgaaataatctgtgccaaacccccgtgacacaagtttacctatttaacaaatgtactgtacccctaaaagttaaaaaagtaaaaatataaaaaaataaaatccctgctttagggagggtgggagggggtgagggaaacagaaactacatactgagtacaatgtacagtagtccagtgatgggtgcactaaaatttcagactttacaccactatacaattcatccatgtaaccagaaaccacttgtacccctaaagctattgaaataaaaagctaaatgagttcccccaccttcctctccccatcaaaatccttgctttagatacaataagagtaggcaatctgtgttctatatgtgttagatgtgtattactggtgaaatgacaagagaaagcaagatatttgactagtaaaaagactaggaggcaagatatttctaatatatcaagcaaaccttttaccatgtgactgaaagcaaataaacttcctaagacctca

SEQ ID NO: 142007 - DNA, 4188 bp, Homo sapiens
  Payload ID: 7921
  Gene Symbol: IER5
  Gene Name: immediate early response 5
  Uniprot ID: Q5VY09
  ENST ID: ENST00000367577
  CDS Start-End: 192-1175
gacccgaaacggggaagttgtcttgtttggagaggttagtagagcagcgcgcgcgtcaccagagtcgtttctcttcggagtcttaggtgatcgagggtgtgcccagggggcggacttgtttgcgcctcccgttccctcccaatttccaaacgtgtcaccccggcgccgacggccctgtgcaggggaagcagatggagttcaagctggaggctcatcgcatcgtcagcatctctctgggcaagatctacaactcgcgggtccagcgcggcggcatcaagctgcataagaacctcctggtctcgctggtgctgcgcagcgcccgccaagtctacctgagcgacccgtgccccggcctctacctggccggtcccgctgggaccccggcgccgccaccgcagcagcagcccggggagccggcggccgggccacccgccggctggggagagccgcccccgcccgccgctcgtgcctcttggccggagaccgagccgcagccggagcgctcctccgtctcagacgcgccgcgggtaggggacgaggtgccggtggccacggtgactggagtcggggacgtttttcagggcggagaggcggacgcgacggaagctgcctggagccgcgtggaggggccgcgccaggcggcggccagagaagccgagggtaccgccggaggctggggcgtcttccccgaggtatctcgtgccgcgcgccgcccctgcggctgccccctaggcggggaggacccgccgggtacaccggccgcgaccccccgcgctgcctgctgctgcgcgccgcaaccagcggaggacgagccccccgcgccgcccgcggtgtgccccaggaagcgctgcgcggcgggggtgggcggcggcccagcgggctgcccggcgcccggctcgaccccgctcaagaagccccgccggaacttagagcagccgccgagtggaggagaggacgacgacgcggaggagatggagaccgggaacgtggctaacctcatcagcatcttcggttccagtttctcgggactcctacggaaaagccccgggggcggcagagaggaagaggagggagaggagagcggtccggaagccgccgagcccgggcagatctgctgcgataagccggtgctgagagacatgaacccctggagcacagccatcgtggccttctgagcccttggcccccctgcggggaggaggtggagcagcgggcgtccccgaagtgagggccaggcccttcccggctgcgaggacgcccagagaccgcgggcgctgagcgcgttgggcagactggttgcctctgggcatcgcaaactgcccccgggcgcatctggcttatctggagacctgggagcttgaggctcattggaagaggacgatcgttaacttttgtgtttgtgtatgtctgtgtatgtaagtttgtcttgtggcattaagactattttgctcttctggaatgcaccactccttccccagggtttaagagattgggggcagacagggactttcctctgccggctgcgtggagaaggaagcggctaaaaggtttgggccggggagttccccattcgttctccggggagggagggactttacacctacccctcaccggaaagctagacccgcttcagggccaggagtggcgtttccgcacaggatttcctaagacgagagggatttagccaagagcacagacttggattccttctgtccctccccacctttctctcccaatgaagaaacgtttatatcctgtgattactctaggaaaggggcgtattaacggtcctttgcttccccgcaggggagaaaaagcttgacgaacttcacagaagagttcaagcttggaaataatggagtttatagagaaaagatatatttttaaaagctctaggtcagaagtactacacagtgcttttaaaaagtgtttaatgagagtttacagacagaagcccgaagtggaaagaccttatggttttgtagatatggtgactccagtctttgttgtataaaggttgggggagctgataaggtttttgtacagtattttctccttcgttgtattgatttttgtataaaaatgtaacttctacgtgtctaacacgtattaaatattttgaagcaacgtaactgcctgcttgtctgtaataacctgcctgggttgggagggaagtgggaggagggaaaccagggcctgagctagaaaattgaaggtgtggttcttagtatcagtcattcgcagactgaggacattgtttactgactccactaagtatcaagagagacacgtttaatttttcctcctagatcagaggactgctattagatactaatatcggcgacctgtcaggttctagaaacctgccactacaactgccttttctaaggtcagtttagaccaatttgtcacccaatatgtgggtgtctaatactaagtaatttaaccaacttttgaagccccgcttatccacaaaaatgtttttcagcaaaactttgtttcctgttaagctattaatacgggtcatcttttagctttgtaattgaaaaaaaaaaagtttagatagtagtttaccttaaaagcccattcgaactgacataggaagatgaaagagactgacttgtccaaattgtcaggtccacctctgcatcacagtggatgtcaggatgtaaattttcagtttttctcttacatctagaaagtaaatatattgctgagagggaaattgtttgcatcaaaccagataaggaaggagggctaggcaaatttagttctcatttagcaaaacttcctgatttgttttgttacttaaatggtgacatcagtgtttggtcatggtagacacttaggtgatgatagccaaaacatccatcgattttactaaaatcactgccattaagagagttttttgtctcttcatgttcaatgtttgaaaggtattcagtaatctatttcagaagcaaatcaattagggaatggtgtttattaaaatacggtacagttgccaggactttaaaagatggtactggtttctaacaacttacgagtatatagggtatttaaaagatgggagagattgaagaaagacaaaggtttaaaggtcatagccttcgagcataagaggcatatgaatggtgtcttggccttaactcccaattatacgaacttctgttttagctgaataggccagtgcctcgtgccttgatatttcggcaaatctattagtggttccttaagcatagggaactttgtactttatgctctgtcgccataataatgtatttatagaattaaacattctcaaattagggtcttgttaaactgactttttctttcagaaagtagctacttaaattctgttacagctacaaaagatccatcaagtgctgactgcttaaactgaagaaggtgtccagggccttaattctgcaaacatttcctgttgttagaaagtatgatgcttgaacagcgatctcagtgtattttatgttttaaagggggtaacgtttggtgtgtttaagagagctgatgtgttttggatgagactaaagttgatccttggttttacattaagatgaacctgggtccatgtgtctgcttaaagaatgtaaattggcatacttgataggaggataaagctttgtaggaattagaaaagatcattctcttttttgttgcagaagcagtatagtatagtagttagagcatgggccctggagccaggctgcttggtgtcttcctttatttatttatttatttaattataaaaagtaaatataaagtgagctatgttgaccaggttcgtcttgaactcctggcctcaagcaatcctcctgcctcagcctcccaaagtgctgggattacaggcatgagccaccacaacctggcctgcttgggtttttctatcttggctctgccacctagctgtgggtccttggacaagttacttcatctctctgtgcctcaggtttttcaaatgtaaaattgggataattggatctgtctcatagggttgtgaaaattaatgagttaatgctcttagaagagtacctcatatgtaataagcacgcaactgttaattattgttaatgtagaagttaattctgtgtataaatcagatacactgtggtcaaagatttgtgtgtatttgtaagaaaagaggagaatggagaatctatttttaagtgg

SEQ ID NO: 142008 - DNA, 2711 bp, Homo sapiens
  Payload ID: 7922
  Gene Symbol: IER5L
  Gene Name: immediate early response 5-like
  Uniprot ID: Q5T953
  ENST ID: ENST00000372491
  CDS Start-End: 211-1425
gactcattgctttggcgccgtctggggagcgcgagcccgcgggtggcgcgcggcgcatggtggcggctcctttcggagcgcagccgaacctctgacccggactccgttacccctgcccggcgcgccccggcggccggctggaggcagaaacagcagaagcgttaacagcagcagcggcggcggctgctccgccgccgtctccgcgggagcatggagtgcgccctggacgcccagagcctgatcagcatctccctgcgcaagatccacagctcccgaacccagcgcggcggcatcaagctgcacaagaacctcctggtgtcctacgtgctccgcaacgcgcgccagctctacctgagcgagcgctacgccgagctctaccggcgccagcagcagcagcaacagcagcagccgccccaccaccagcaccagcacctagcgtacgcggcgccgggcatgccggccagcgcggccgacttcggcccgctccaacttggcggcggcggggacgcggaggcgcgcgagccggccgcccggcaccagctgcaccagctccaccagctccaccagctgcacctccagcagcagctgcaccagcaccagcacccggcgcccaggggctgcgcggcggcggcggcggccggagcgcccgcgggcggcgcgggggcgctctcggagctgcccgggtgcgccgcgctccagccgccgcacggcgcgccccaccgcgggcagcccttggagcctctgcagccgggtcctgcgccgctgccgctgccgctgccgccgcccgcgcccgctgcgctctgcccgcgggaccctcgcgccccggccgcctgctccgcgcccccaggggccgcccctccggccgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgcgcccgcttcgaggacttctgcccggactcgtccccggacgcgtccaacatctcaaacttgatctccatctttggctccggcttctcggggctggtgagccgacagccggactcctcggagcagccgccgccgctcaacgggcagctgtgcgccaagcaggcgctcgccagcctcggcgcctggactcgagccattgtcgccttctagggacccccgagggcacagggacccggggccccgcggggctggggccagacaaagactcggcaaaggggcgagaggagggaacgagcgggcgccgggccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctgtggggtgaggaatgggtcttgtgaaattctgagcaaaaacaaaggcaaactctatctccgaaagggacgtttgggtcacatttcctctctgggggcggactccaaagttctcaaaatgagaaggcagaaatgaaaacacttcaactttttttttcttttcttcccggggcgggtgtcttgaacccctcttctccccgcccctctggctccgttctcctcccctcctccacccgtctcccggactcgggggtggcgcctgacaccccgacactctcggacactgggtaaggggtggggggcgggcacggcggactacatttcccatcatgcctagcactgcggtcctcactaaacaaaaaaggaagtcaattccttcacctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacagaa

SEQ ID NO: 142009 - DNA, 1662 bp, Homo sapiens
  Payload ID: 7923
  Gene Symbol: IRGC
  Gene Name: immunity-related GTPase family, cinema
  Uniprot ID: Q6NXR0
  ENST ID: ENST00000244314
  CDS Start-End: 200-1591
aggtctggctgaccaataagctgctgcttgctatgataatgggtcctagcaacggtgtctgaccttggctaagagggaaggagatcctatcagtggggagagtgtgaggggagagggagagcctgcagggcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataaagagtgcagccccgcccccctgcctcacccacaaactaagtcttaacaaaatccaaattaccaacaaaaaa

SEQ ID NO: 142010 - DNA, 926 bp, Homo sapiens
  Payload ID: 7923
  Gene Symbol: IRGC
  Gene Name: immunity-related GTPase family, cinema
  ENST ID: ENST00000596627
  CDS Start-End: 102-926
agtgtgaggggagagggagagcctgcagggcaggaaaaagagagctgtgggcttccagggcgactcccttcacatccgtggtatctgtctctccctgccccatgccaaggcccaggaggtgtgaatggctcccttctcctctgcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcc

SEQ ID NO: 142011 - DNA, 1659 bp, Homo sapiens
  Payload ID: 7924
  Gene Symbol: IRGM
  Gene Name: immunity-related GTPase family, M
  Uniprot ID: A1A4Y4
  ENST ID: ENST00000522154
  CDS Start-End: 1114-1659
taacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgagcttactccagtgcccacagatacgacagagtgtcccaagtgcccctcacactctattagctgcatccttaacctctttttgccacaccataagcattgggttttgtttgttttgagatggagtcttgctctgttgccaggctggagtgcaatggcgtgatctcagctcactgcaatatctgcgtccagggttcaagcgattcccctgcctcagcctcctgtattagctgggactacaggcgcacaccaccacgcgcagctaatttttttgtattttagtagagaaggtttcacgatgttggccaggatggtctcaatctcctgacctcgtgatctgctcgcctcggccttccaaagtgctgggattacaggcatgagccacggcgcctggccagcattggggtattttattgaagatggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaa

SEQ ID NO: 142012 - DNA, 503 bp, Homo sapiens
  Payload ID: 7924
  Gene Symbol: IRGM
  Gene Name: immunity-related GTPase family, M
  ENST ID: ENST00000520549
  CDS Start-End: 1-215
tgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcggagctctagaaaccaacaagtgtacccaaaccacagccacgtacctcttgcttgctgaaaggatcctgagagaaaagcaagacaaagaaatacagatcagctccgcaagccctagaaatagcaaggcccagctcagctggcctgccatgagaaatacctcaagagtactccagagaattccacaaggcccagaaatattccttccagaagaaaactatacgtaaatctgctcaggatattcaacagctagccagtgcatatgacatatactgggtacttaagaaacgtttgttaaatgaatcatgattataaagaaaaaataaattaaaacttatgtttagttaaa

SEQ ID NO: 142013 - DNA, 9685 bp, Homo sapiens
  Payload ID: 7925
  Gene Symbol: IRGQ
  Gene Name: immunity-related GTPase family, Q
  Uniprot ID: Q8WZA9
  ENST ID: ENST00000422989
  CDS Start-End: 157-2028
caggttaaagctaccgggacgggtcccggcatctctaaatcaccgctccctggcctcttcggcctccgtccgccgcggcccaggggccgggcttctcagctgctgacctactgccaccgactgcgctctctcccgtgggtcggctttttgctcgccatgcctccgccgcagggtgacgtgaccgccttgttcctggggcctccgggcttggggaagtccgcgctgatcgcagcgctgtgcgacaaggatgtggagacgctcgaggcccccgagggacggccggactccggggttcccagcctaagagctgcgggcccaggcctttttctgggcgagctgagctgcccacccgcagcgccggggccctgggcggcggaagccaacgtgctggtactggtgctgcccggacccgaggggaacggggaaccgttggctccagccctgggagaggcagcgctggccgccctggcccgagggaccccgctactggctgtgcggaacctccgtcctggggattcacagactgccgcccaggcccgtgatcagacagcagctctgctgaacagcgcggggttaggagctgcggatctgtttgtgctaccggcgaactgcggcagcagcgacggctgcgaggagctagagcgcctccgggcggcgctgcagagccaggcagaagcgctgcggaggctcctgccaccggcgcaggatggcttcgaggtgttgggtgcagcagagctagaggctgtgcgtgaggcctttgagaccggcggccttgaggctgcgctgtcgtgggtgcgctcaggcctggagcgcctgggcagcgcacggctagacctggccgtggctggcaaggctgacgtgggccttgtggtggacatgctgcttggattggatcctggcgacccaggcgctgcgcctgcttcggtccccacagcacccactcccttcccagccccagagcgcccgaatgtggtgctctggaccgtgcctctgggccacacgggcactgccaccaccgcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaaggcaagatggagaatcccaagggcgagagcttaaagaacgcaggtggagggggattggagaatgcactcagtaagggaagggagaaatgtagcgctggatcgcagaaagcaggcagcggggaaggtcctgggaaagctggcagcgagggtttgcagcaggttgtcggcatgaagaaatcaggtggtggcgactcagagcgggccgctgcgttaagcccggaggacgagacgtgggaggtgctggaggaggcgccgccgccagtgttccccctacggcctggcggactcccagggctatgcgaatggctgcggcgagcgctccccccagcccaggcaggggcactgctgctggcgttgccaccagcatctcccagcgctgcccgaaccaaggctgcggcgttgcgagccggggcgtggaggccagctctgctggctagtctggcggcggcggcggcaccactcccagggctgggctgggcatgcgacgtggcacttctgcggggtcagctggcggagtggcgacggggcctggggctggaacccacggcactggctcgacgtgagcgtgccctgggcctggcttctggagagctggcagcgcgcgctcatttcccaggcccggtgacgcgcgccgaggtggaagcaagactgggcgcctgggcgggcgagggcactgctgggggcgcagcactgggggctctctccttcctgtggcctgcgggtggtgcagcggcgacaggtggcctgggctaccgagcggctcacggcgtcctgctgcaggctctcgatgagatgcgggctgatgctgaggctgtgctggcaccccctgagcctgcccagtgaggagtgggagggggcttgggagtccagactctgacaggggatgcctgggcttaatcctgggtgcttgaaggggatgtggactcttgacttccagctgggatgtgtgacttcttatcacctggattcagagagtctgggggacaggaatcctgatttttttttttttttttcttttttttgtgagacgaagtctcttgttgcccaggctggagtgcaatggcgcgacctcggctcactgcaacctccgcctcccgggttcaagcgattctcctgcctcagcgtccggagtagctgggattacaggtgcctgccaccacacctggctaatttttgtatttttagtagagacggggtttcaccatgttggccaggctggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccagttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccatcacccaggctggagtgcagtggcacgatctcgcctcactgcaacctccgcctcccaggttcatgtgattctcctgcctcagcctcctgagtagctgggattacaggcatatgccaccatgcctggctaatttttgtatttttagtagagatggggtttcaccatgttgatcaggctggtctggaactactgacctcaggccacccgccttggcctcccaaagtgctgggattacaggcatgagccaccgcgcccagctaatttttgtatttttattttatttatttatttattttttgggagacggagtcttgctctgtcacccaggctggagtgcagttgtgcgatcttggctcactgcaacctcagcctcccaagtagctgggattacaggcatgcaccatcatgcccagctaatttttgtatttttagtagagatggggtttcactgtgttggccaggctggtcttgaactcctgacctcaggtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctagctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatcctattgcgtgtctgttcttttggagtttgagggaaaagaaagatccttgagattttgactgggctggaaacctagactccagcgtctggggataggagggatggtggggaatccgctgggaaaaactgggctgtgatcaagagaatttatcagtatctgagtttttccaccctggaaggagtgcgggcagacttactgtttaaacattgggagcttatgatggtaaagcgccttagttctggagccaggtatacccattaatgaccccaactgggccagcctttctgtagccatgcccttggattgttgctctccttctaggtttgactatgtggtttgcttcagccactagaacaatagcaaacatgatacaagcagaggcttggaaagtgcttatgcggccgggtgtggtggctcacacctataatcccagcactttgggaggccagggcgggcagatcacaaggtcaggagatcgagaccatcctggctaacacagtgaaaccccgtctctctactaaaaatacaaaaaattagctgggtgtggtggtgcacacctgtagtcccagctactcgggaggctgaggcaggagaatagcttgaacctgggaggcggaggttgtagtgagctgagactgcgccgctgcactccagcctgggcaacagagcgagacttctctcaaaaaaaaaaaaccaaagtgcttatgcactgggacttcctctcttgctccccttgggacccctaccaccactgccacatccaaaccccgggctggctgagcatggtggcatatgggtataaacccataatcccagcacttagggaggcaaaggtggaagaatttcatgagcccaggagatcgagactagcctgagcaacatggcaagacccccatctctacaaaaaagcaacaacaacagaattagccagatgtggtggtgtgcacctgtggtcccaactacatgggggaggctgaggcaagtggattgtttgagcccaggaagtcgaggctgaagtgagctatgatggctccactgcactccagcctgggtgacagagcaagacaatgtctaaaaaaataaaaagaaggaaagaaaaggaaaagatctgggctaacctgctgggtaataaagggaaaagagacacatggctccgtcatccttgatccctgccacccatagccaaccaacctctgaaacagagctccctagctgataggcagctgaacccagctgagaccagcaaaagaactgcccagctgatcccagaccaagttgcaacccagagaatcattaactaaataggtgattgttctaaaccactaaattttggagtggtttgttatgtagcaaaagcaactaatacagacttgttctctctgtgtgtgatgtggtctctttctccccaacaacatgacccaatgattaaaatcttaaattctgccactttttagctgtgtgactgccaatgtgacagccttctgagcctctgatgtctcctgaaaacagagatgtgaataatagtgcctatgacatagagttgtgaaaataaaatgaaaaacagcttctt

SEQ ID NO: 142014 - DNA, 564 bp, Homo sapiens
  Payload ID: 7925
  Gene Symbol: IRGQ
  Gene Name: immunity-related GTPase family, Q
  ENST ID: ENST00000598324
  CDS Start-End: 157-564
caggttaaagctaccgggacgggtcccggcatctctaaatcaccgctccctggcctcttcggcctccgtccgccgcggcccaggggccgggcttctcagctgctgacctactgccaccgactgcgctctctcccgtgggtcggctttttgctcgccatgcctccgccgcagggtgacgtgaccgccttgttcctggggcctccgggcttggggaagtccgcgctgatcgcagcgctgtgcgacaaggatgtggagacgctcgaggcccccgagggacggccggactccggggttcccagcctaagagctgcgggcccaggcctttttctgggcgagctgagctgcccacccgcagcgccggggccctgggcggcggaagccaacgtgctggtactggtgctgcccggacccgaggggaacggggaaccgttggctccagccctgggagaggcagcgctggccgccctggcccgagggaccccgctactggctgtgcggaacctccgtcctggggattcacagactgccgcccaggcccgtgatcagacagcagctctgctgaac

SEQ ID NO: 142015 - DNA, 2210 bp, Homo sapiens
  Payload ID: 7925
  Gene Symbol: IRGQ
  Gene Name: immunity-related GTPase family, Q
  Uniprot ID: Q8WZA9
  ENST ID: ENST00000602269
  CDS Start-End: 187-2058
aggacgcctgggattctgggggaatagggtctgggctctggattttttaggtcctggagagtgacactcaagaaccgaaggggacagggtgaaggactgaggcctgggttccgagtggggcggctaggaaaggaaaaggctaggtgctccctgacccaggtcttctctacccgttgctttccagccatgcctccgccgcagggtgacgtgaccgccttgttcctggggcctccgggcttggggaagtccgcgctgatcgcagcgctgtgcgacaaggatgtggagacgctcgaggcccccgagggacggccggactccggggttcccagcctaagagctgcgggcccaggcctttttctgggcgagctgagctgcccacccgcagcgccggggccctgggcggcggaagccaacgtgctggtactggtgctgcccggacccgaggggaacggggaaccgttggctccagccctgggagaggcagcgctggccgccctggcccgagggaccccgctactggctgtgcggaacctccgtcctggggattcacagactgccgcccaggcccgtgatcagacagcagctctgctgaacagcgcggggttaggagctgcggatctgtttgtgctaccggcgaactgcggcagcagcgacggctgcgaggagctagagcgcctccgggcggcgctgcagagccaggcagaagcgctgcggaggctcctgccaccggcgcaggatggcttcgaggtgttgggtgcagcagagctagaggctgtgcgtgaggcctttgagaccggcggccttgaggctgcgctgtcgtgggtgcgctcaggcctggagcgcctgggcagcgcacggctagacctggccgtggctggcaaggctgacgtgggccttgtggtggacatgctgcttggattggatcctggcgacccaggcgctgcgcctgcttcggtccccacagcacccactcccttcccagccccagagcgcccgaatgtggtgctctggaccgtgcctctgggccacacgggcactgccaccaccgcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaaggcaagatggagaatcccaagggcgagagcttaaagaacgcaggtggagggggattggagaatgcactcagtaagggaagggagaaatgtagcgctggatcgcagaaagcaggcagcggggaaggtcctgggaaagctggcagcgagggtttgcagcaggttgtcggcatgaagaaatcaggtggtggcgactcagagcgggccgctgcgttaagcccggaggacgagacgtgggaggtgctggaggaggcgccgccgccagtgttccccctacggcctggcggactcccagggctatgcgaatggctgcggcgagcgctccccccagcccaggcaggggcactgctgctggcgttgccaccagcatctcccagcgctgcccgaaccaaggctgcggcgttgcgagccggggcgtggaggccagctctgctggctagtctggcggcggcggcggcaccactcccagggctgggctgggcatgcgacgtggcacttctgcggggtcagctggcggagtggcgacggggcctggggctggaacccacggcactggctcgacgtgagcgtgccctgggcctggcttctggagagctggcagcgcgcgctcatttcccaggcccggtgacgcgcgccgaggtggaagcaagactgggcgcctgggcgggcgagggcactgctgggggcgcagcactgggggctctctccttcctgtggcctgcgggtggtgcagcggcgacaggtggcctgggctaccgagcggctcacggcgtcctgctgcaggctctcgatgagatgcgggctgatgctgaggctgtgctggcaccccctgagcctgcccagtgaggagtgggagggggcttgggagtccagactctgacaggggatgcctgggcttaatcctgggtgcttgaaggggatgtggactcttgacttccagctgggatgtgtgacttcttatcacctggattcagagagtctgggggacaggaatcctg

SEQ ID NO: 142016 - DNA, 1943 bp, Homo sapiens
  Payload ID: 7926
  Gene Symbol: IGSF21
  Gene Name: immunoglobin superfamily, member 21
  Uniprot ID: Q96ID5
  ENST ID: ENST00000251296
  CDS Start-End: 384-1787
aggaggggggtgctcgcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccgccaccgcctccacccccgccgccccgccaccgccgccagctcccgggcaccatgcgaaccgccccgagcctccgccgctgcgtctgcctgctgctcgccgcgatcctggacctggcgcgcggctacctgacagtcaacattgagcctctcccccctgtggtggctggagacgccgtgactttgaagtgtaacttcaagacagatgggcgcatgcgggagatcgtgtggtaccgggtgacggatggtggcaccatcaagcaaaagatcttcaccttcgacgccatgttctccaccaactactcacacatggagaactaccgcaagcgagaggacctggtgtaccagtccactgtgaggctgcccgaggtccggatctcagacaatggtccctatgagtgccatgtgggcatctacgaccgcgccaccagggagaaggtggtcctggcatcaggcaacatcttcctcaacgtcatggctcctcccacctccattgaagtggtggctgctgacacaccagcccccttcagccgctaccaagcccagaacttcacgctggtctgcatcgtgtctggaggaaaaccagcacccatggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctggttgcccccaaaggacccaaaattgtgatgacgcccagcagagcccgggtaggggacacagtgaggattctggtccatgggtttcagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttgaaaacccaaatatcccaagaggaacggaggactctaatggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccc

SEQ ID NO: 142017 - DNA, 1666 bp, Homo sapiens
  Payload ID: 7927
  Gene Symbol: IGBP1
  Gene Name: immunoglobulin (CD79A) binding protein 1
  Uniprot ID: P78318
  ENST ID: ENST00000356413
  CDS Start-End: 304-1323
cgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaa

SEQ ID NO: 142018 - DNA, 1862 bp, Homo sapiens
  Payload ID: 7927
  Gene Symbol: IGBP1
  Gene Name: immunoglobulin (CD79A) binding protein 1
  Uniprot ID: P78318
  ENST ID: ENST00000342206
  CDS Start-End: 500-1519
acttcgcgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaa

SEQ ID NO: 142019 - DNA, 1112 bp, Homo sapiens
  Payload ID: 7928
  Gene Symbol: IGHA1
  Gene Name: immunoglobulin heavy constant alpha 1
  Uniprot ID: P01876
  ENST ID: ENST00000390547
  CDS Start-End: 1-1062
gcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagcag

SEQ ID NO: 142020 - DNA, 1112 bp, Homo sapiens; identical to SEQ ID NO: 142019
  Payload ID: 7928
  Gene Symbol: IGHA1
  Gene Name: immunoglobulin heavy constant alpha 1
  Uniprot ID: P01876
  ENST ID: ENST00000633714
  CDS Start-End: 1-1062

SEQ ID NO: 142021 - DNA, 1071 bp, Homo sapiens
  Payload ID: 7929
  Gene Symbol: IGHA2
  Gene Name: immunoglobulin heavy constant alpha 2 (A2m marker)
  ENST ID: ENST00000390539
  CDS Start-End: 1-1023
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaattccagccaggatgtgactgtgccctgccgagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccacctacgctgtaaccagcatactgcgcgtggcagctgaggactggaagaagggggagaccttctcctgcatggtgggccacgaggccctgccgctggccttcacacagaagaccatcgaccgcatggcgggtaaacccacccacatcaatgtgtctgttgtcatggcggaggcggatggcacctgctactgagccgcccgcctgtccccacccctgaataaactccatgctcccccaagc

SEQ ID NO: 142022 - DNA, 1071 bp, Homo sapiens
  Payload ID: 7929
  Gene Symbol: IGHA2
  Gene Name: immunoglobulin heavy constant alpha 2 (A2m marker)
  ENST ID: ENST00000622473
  CDS Start-End: 1-1023
gcatccccgaccagccccaaggtcttcccgctgagcctcgacagcaccccccaagatgggaacgtggtcgtcgcatgcctggtccagggcttcttcccccaggagccactcagtgtgacctggagcgaaagcggacagaacgtgaccgccagaaacttcccacctagccaggatgcctccggggacctgtacaccacgagcagccagctgaccctgccggccacacagtgcccagacggcaagtccgtgacatgccacgtgaagcactacacgaatcccagccaggatgtgactgtgccctgcccagttcccccacctcccccatgctgccacccccgactgtcgctgcaccgaccggccctcgaggacctgctcttaggttcagaagcgaacctcacgtgcacactgaccggcctgagagatgcctctggtgccaccttcacctggacgccctcaagtgggaagagcgctgttcaaggaccacctgagcgtgacctctgtggctgctacagcgtgtccagtgtcctgcctggctgtgcccagccatggaaccatggggagaccttcacctgcactgctgcccaccccgagttgaagaccccactaaccgccaacatcacaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagc

SEQ ID NO: 142023 - DNA, 1678 bp, Homo sapiens
  Payload ID: 7930
  Gene Symbol: IGHD
  Gene Name: immunoglobulin heavy constant delta
  ENST ID: ENST00000390556
  CDS Start-End: 1-1292
cacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctacctggccatgacccccctgatccctcagagcaaggatgagaacagcgatgactacacgacctttgatgatgtgggcagcctgtggaccaccctgtccacgtttgtggccctcttcatcctcaccctcctctacagcggcattgtcactttcatcaaggtgaagtagccccagaagagcaggacgccctgtacctgcagagaagggaagcagcctctgtacctcatctgtggctaccagagagcagaaaggacccaccctggactcttctgtgtgcaggaagatgcgccagcccctgcccccggctcccctctgtccgccacagaacccagtcttctagaccagggggacgggcacccatcactccgcaggcgaatcagagcccccctgccccggccctaacccctgtgcctccttcccatgcttccccgagagccagctacacccctgccccggccctaacccccatgcctccttcctgtgcttcccccagagccagctagtcccacctgcagcccgctggcctccccataaacacactttggttcatttca

SEQ ID NO: 142024 - DNA, 1155 bp, Homo sapiens
  Payload ID: 7930
  Gene Symbol: IGHD
  Gene Name: immunoglobulin heavy constant delta
  ENST ID: ENST00000612319
  CDS Start-End: 1-1155
gcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaatga

SEQ ID NO: 142025 - DNA, 1155 bp, Homo sapiens; identical to SEQ ID NO: 142024
  Payload ID: 7930
  Gene Symbol: IGHD
  Gene Name: immunoglobulin heavy constant delta
  ENST ID: ENST00000613640
  CDS Start-End: 1-1155

SEQ ID NO: 142026 - DNA, 1678 bp, Homo sapiens; identical to SEQ ID NO: 142023
  Payload ID: 7930
  Gene Symbol: IGHD
  Gene Name: immunoglobulin heavy constant delta
  ENST ID: ENST00000633698
  CDS Start-End: 1-1292

SEQ ID NO: 142027 - DNA, 1412 bp, Homo sapiens
  Payload ID: 7931
  Gene Symbol: IGHE
  Gene Name: immunoglobulin heavy constant epsilon
  Uniprot ID: P01854
  ENST ID: ENST00000390541
  CDS Start-End: 1-1287
gcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcaagcccctcacagaccgtccagcgagcggtgtctgtaaatcccggtaaatgacgtactcctgcctccctccctcccagggctccatccagctgtgcagtggggaggactggccagaccttctgtccactgttgcaatgaccccaggaagctacccccaataaactgtgcctgctcag

SEQ ID NO: 142028 - DNA, 1412 bp, Homo sapiens
  Payload ID: 7931
  Gene Symbol: IGHE
  Gene Name: immunoglobulin heavy constant epsilon
  Uniprot ID: P01854
  ENST ID: ENST00000610670
  CDS Start-End: 1-1287
gcctccacacagagcccatccgtcttccccttgacccgctgctgcaaaaacattccctccaatgccacctccgtgactctgggctgcctggccacgggctacttcccggagccggtgatggtgacctgggacacaggctccctcaacgggacaactatgaccttaccagccaccaccctcacgctctctggtcactatgccaccatcagcttgctgaccgtctcgggtgcgtgggccaagcagatgttcacctgccgtgtggcacacactccatcgtccacagactgggtcgacaacaaaaccttcagcgtctgctccagggacttcaccccgcccaccgtgaagatcttacagtcgtcctgcgacggcggcgggcacttccccccgaccatccagctcctgtgcctcgtctctgggtacaccccagggactatcaacatcacctggctggaggacgggcaggtcatggacgtggacttgtccaccgcctctaccacgcaggagggtgagctggcctccacacaaagcgagctcaccctcagccagaagcactggctgtcagaccgcacctacacctgccaggtcacctatcaaggtcacacctttgaggacagcaccaagaagtgtgcagattccaacccgagaggggtgagcgcctacctaagccggcccagcccgttcgacctgttcatccgcaagtcgcccacgatcacctgtctggtggtggacctggcacccagcaaggggaccgtgaacctgacctggtcccgggccagtgggaagcctgtgaaccactccaccagaaaggaggagaagcagcgcaatggcacgttaaccgtcacgtccaccctgccggtgggcacccgagactggatcgagggggagacctaccagtgcagggtgacccacccccacctgcccagggccctcatgcggtccacgaccaagaccagcggcccgcgtgctgccccggaagtctatgcgtttgcgacgccggagtggccggggagccgggacaagcgcaccctcgcctgcctgatccagaacttcatgcctgaggacatctcggtgcagtggctgcacaacgaggtgcagctcccggacgcccggcacagcacgacgcagccccgcaagaccaagggctccggcttcttcgtcttcagccgcctggaggtgaccagggccgaatgggagcagaaagatgagttcatctgccgtgcagtccatgaggcagcgagcccctcacagaccgtccagcgagcggtgtctgtaaatcccggtaaatgacgtactcctgcctccctccctcccagggctccatccagctgtgcagtggggaggactggccagaccttctgtccactgttgcaatgaccccaggaagctacccccaataaactgtgcctgctcag

SEQ ID NO: 142029 - DNA, 1022 bp, Homo sapiens
  Payload ID: 7932
  Gene Symbol: IGHG1
  Gene Name: immunoglobulin heavy constant gamma 1 (G1m marker)
  ENST ID: ENST00000390542
  CDS Start-End: 1-888
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcg

SEQ ID NO: 142030 - DNA, 2619 bp, Homo sapiens
  Payload ID: 7932
  Gene Symbol: IGHG1
  Gene Name: immunoglobulin heavy constant gamma 1 (G1m marker)
  ENST ID: ENST00000390548
  CDS Start-End: 1-1200
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatgactctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggacctcgccctggagccaaccccgtccacgccagcctcctgaacacaggcgtggtttccagatggtgagtgggagcgtcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcagtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgta

SEQ ID NO: 142031 - DNA, 1128 bp, Homo sapiens
  Payload ID: 7932
  Gene Symbol: IGHG1
  Gene Name: immunoglobulin heavy constant gamma 1 (G1m marker)
  Uniprot ID: P01857
  ENST ID: ENST00000390549
  CDS Start-End: 1-993
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcga

SEQ ID NO: 142032 - DNA, 1543 bp, Homo sapiens
  Payload ID: 7932
  Gene Symbol: IGHG1
  Gene Name: immunoglobulin heavy constant gamma 1 (G1m marker)
  ENST ID: ENST00000617630
  CDS Start-End: 21-1409
tggacctcctgcacaagaacatgaaacacctgtggttcttcctcctcctggtggcagctcccagatgggtcctgtctcaggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtcacaatgtgacaactggttcgacccctggggccagggaaccctggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcg

SEQ ID NO: 142033 - DNA, 1628 bp, Homo sapiens
  Payload ID: 7932
  Gene Symbol: IGHG1
  Gene Name: immunoglobulin heavy constant gamma 1 (G1m marker)
  ENST ID: ENST00000613158
  CDS Start-End: 81-1502
agctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtggagtctgggggaggtgtggtacggcctggggggtccctgagactctcctttgcagcctctggattcacctttgatgattatggcatgagctgggtccgccaagctccagggaaggggctggagtgggtctctggtattaattggaatggtggtagcacagactatgtggactctgtgaagggccgattcaccatctccagagacaacgccaagaactcactgtatctgcaaatgaacagcctgagagccgaggacacggccgtgtattactgtgcgagagacacagtgaggggaagtcagtactactactactacatggacgtctggggcaaagggaccacggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctggg

SEQ ID NO: 142034 - DNA, 1595 bp, Homo sapiens
  Payload ID: 7932
  Gene Symbol: IGHG1
  Gene Name: immunoglobulin heavy constant gamma 1 (G1m marker)
  ENST ID: ENST00000615782
  CDS Start-End: 68-1462
gagccccagccctgagattcccacgtgtttccattcagtgatcagcactgaacacagaggactcgccatggagtttgggctgagctgggttttccttgttgctattttaaaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtcccagttattagtggtagtggtagtaccatgtactacgcagactctgtgaagggccgattcaccatttccagagacaatacgaaaaactcactgtatctgcaaatgaacagactgagggcagaggatgcagctgcatatgactgtgagagatacgactactttgactactggggccagggaaccctggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgc

SEQ ID NO: 142035 - DNA, 1428 bp, Homo sapiens
  Payload ID: 7932
  Gene Symbol: IGHG1
  Gene Name: immunoglobulin heavy constant gamma 1 (G1m marker)
  ENST ID: ENST00000618583
  CDS Start-End: 1-1428
atggactggacctggaggatcctctttttggtggcagcagccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgagagaggatggacattctgccattgattactactactactactacatggacgtctggggcaaagggaccacggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatga

SEQ ID NO: 142036 - DNA, 1597 bp, Homo sapiens
  Payload ID: 7932
  Gene Symbol: IGHG1
  Gene Name: immunoglobulin heavy constant gamma 1 (G1m marker)
  ENST ID: ENST00000616331
  CDS Start-End: 63-1463
cttagccctggactccaaggcctttccacttggtgatcagcactgagcacagaggactcaccatggagttggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggccgtgtattactgtgcgagagaatgtgacaactggttcgacccctggggccagggaaccctggtcaccgtctcctcagcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcg

SEQ ID NO: 142037 - DNA, 2619 bp, Homo sapiens; identical to SEQ ID NO: 142030
  Payload ID: 7932
  Gene Symbol: IGHG1
  Gene Name: immunoglobulin heavy constant gamma 1 (G1m marker)
  ENST ID: ENST00000631539
  CDS Start-End: 1-1200

SEQ ID NO: 142038 - DNA, 1128 bp, Homo sapiens; identical to SEQ ID NO: 142031
  Payload ID: 7932
  Gene Symbol: IGHG1
  Gene Name: immunoglobulin heavy constant gamma 1 (G1m marker)
  Uniprot ID: P01857
  ENST ID: ENST00000631466
  CDS Start-End: 1-993

SEQ ID NO: 142039 - DNA, 1022 bp, Homo sapiens; identical to SEQ ID NO: 142029
  Payload ID: 7932
  Gene Symbol: IGHG1
  Gene Name: immunoglobulin heavy constant gamma 1 (G1m marker)
  ENST ID: ENST00000631402
  CDS Start-End: 1-888

SEQ ID NO: 142040 - DNA, 1132 bp, Homo sapiens
  Payload ID: 7933
  Gene Symbol: IGHG2
  Gene Name: immunoglobulin heavy constant gamma 2 (G2m marker)
  Uniprot ID: P01859
  ENST ID: ENST00000390545
  CDS Start-End: 1-981
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtctacatacttcccgggcacccagcatggaaataaagcacccagcgctgccctgggcccctgcgagactgtgatggttctt

SEQ ID NO: 142041 - DNA, 1114 bp, Homo sapiens
  Payload ID: 7933
  Gene Symbol: IGHG2
  Gene Name: immunoglobulin heavy constant gamma 2 (G2m marker)
  Uniprot ID: P01859
  ENST ID: ENST00000621803
  CDS Start-End: 1-981
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtctacatacttcccgggcacccagcatggaaataaagcacccagcgctgccctgggcccctgc

SEQ ID NO: 142042 - DNA, 1268 bp, Homo sapiens
  Payload ID: 7934
  Gene Symbol: IGHG3
  Gene Name: immunoglobulin heavy constant gamma 3 (G3m marker)
  ENST ID: ENST00000390551
  CDS Start-End: 1-1133
cttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgagtgcgacggccggcaagcccccgctccccgggctctcggggtcgcgcgaggatgcttggcacgtaccccgtgtacatacttcccgggcacccagcatggaaataaagcacccagcgctgccctgggcccctgcga

SEQ ID NO: 142043 - DNA, 1566 bp, Homo sapiens
  Payload ID: 7934
  Gene Symbol: IGHG3
  Gene Name: immunoglobulin heavy constant gamma 3 (G3m marker)
  ENST ID: ENST00000611473
  CDS Start-End: 1-1566
atggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcggcacctcctcgtggctgaatacttcctggggccagggcaccctggtcaccgtctcctcagcttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatga

SEQ ID NO: 142044 - DNA, 1732 bp, Homo sapiens
  Payload ID: 7934
  Gene Symbol: IGHG3
  Gene Name: immunoglobulin heavy constant gamma 3 (G3m marker)
  ENST ID: ENST00000610824
  CDS Start-End: 45-1598
aaccacatccctcctcagaagcccccagagcacaacgcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagacacagtgtgaaaacccactgtgactactttgactactggggccagggaaccctggtcaccgtctcctcagcttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgagtgcgacggccggcaagcccccgctccccgggctctcggggtcgcgcgaggatgcttggcacgtaccccgtgtacatacttcccgggcacccagcatggaaataaagcacccagcgctgccctgggcccctgcg

SEQ ID NO: 142045 - DNA, 1266 bp, Homo sapiens
  Payload ID: 7934
  Gene Symbol: IGHG3
  Gene Name: immunoglobulin heavy constant gamma 3 (G3m marker)
  ENST ID: ENST00000632774
  CDS Start-End: 1-1133
cttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgagtgcgacggccggcaagcccccgctccccgggctctcggggtcgcgcgaggatgcttggcacgtaccccgtgtacatacttcccgggcacccagcatggaaataaagcacccagcgctgccctgggcccctgc

SEQ ID NO: 142046 - DNA, 1119 bp, Homo sapiens
  Payload ID: 7935
  Gene Symbol: IGHG4
  Gene Name: immunoglobulin heavy constant gamma 4 (G4m marker)
  Uniprot ID: P01861
  ENST ID: ENST00000390543
  CDS Start-End: 1-984
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaatgagtgccagggccggcaagcccccgctccccgggctctcggggtcgcgcgaggatgcttggcacgtaccccgtgtacatacttcccgggcgcccagcatggaaataaagcacccagcgctgccctgggcccctgcga

SEQ ID NO: 142047 - DNA, 1119 bp, Homo sapiens; identical to SEQ ID NO: 142046
  Payload ID: 7935
  Gene Symbol: IGHG4
  Gene Name: immunoglobulin heavy constant gamma 4 (G4m marker)
  Uniprot ID: P01861
  ENST ID: ENST00000618981
  CDS Start-End: 1-984

SEQ ID NO: 142048 - DNA, 1485 bp, Homo sapiens
  Payload ID: 7936
  Gene Symbol: IGHM
  Gene Name: immunoglobulin heavy constant mu
  ENST ID: ENST00000390559
  CDS Start-End: 1-1362
gggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcggccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctactgaccctgctggcctgcccacaggctcggggcggctggccgctctgtgtgtgcatgcaaactaaccgtgtcaacggggtgagatgttgcatcttataaaattagaaataaaaagatccattcaaaa

SEQ ID NO: 142049 - DNA, 1883 bp, Homo sapiens
  Payload ID: 7936
  Gene Symbol: IGHM
  Gene Name: immunoglobulin heavy constant mu
  ENST ID: ENST00000622287
  CDS Start-End: 28-1827
ccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattactatggttcggggagtgacaactggttcgacccctggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcggccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctactgaccctgctggcctgcccacaggctcggggcggctggccgctctgtgtgtgcatgcaa

SEQ ID NO: 142050 - DNA, 1880 bp, Homo sapiens
  Payload ID: 7936
  Gene Symbol: IGHM
  Gene Name: immunoglobulin heavy constant mu
  ENST ID: ENST00000615655
  CDS Start-End: 58-1824
ccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtttcatacattagtagtagtagtagttacacaaactacgcagactctgtgaagggccgattcaccatctccagagacaacgccaagaactcactgtatctgcaaatgaacagcctgagagccgaggacacggctgtgtattactgtgcgagagacacagtgaggggaggtcagtggggccagggaaccctggtcaccgtctcctcagggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcggccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggcgaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccggtaaacccaccctgtacaacgtgtccctggtcatgtccgacacagctggcacctgctactgaccctgctggcctgcccacaggctcggggcggctggccgctctgtgtgtgcatgcaa

SEQ ID NO: 142051 - DNA, 1485 bp, Homo sapiens; identical to SEQ ID NO: 142048
  Payload ID: 7936
  Gene Symbol: IGHM
  Gene Name: immunoglobulin heavy constant mu
  ENST ID: ENST00000626472
  CDS Start-End: 1-1362

SEQ ID NO: 142052 - DNA, 17 bp, Homo sapiens
  Payload ID: 7937
  Gene Symbol: IGHD1OR15-1A
  Gene Name: immunoglobulin heavy diversity 1/OR15-1A (non-functional)
  ENST ID: ENST00000605284
  CDS Start-End: 1-17
ggtataactggaacaac

SEQ ID NO: 142053 - DNA, 17 bp, Homo sapiens
  Payload ID: 7938
  Gene Symbol: IGHD1OR15-1B
  Gene Name: immunoglobulin heavy diversity 1/OR15-1B (non-functional)
  ENST ID: ENST00000604838
  CDS Start-End: 1-17
ggtataactggaacaac

SEQ ID NO: 142054 - DNA, 17 bp, Homo sapiens
  Payload ID: 7939
  Gene Symbol: IGHD1-1
  Gene Name: immunoglobulin heavy diversity 1-1
  ENST ID: ENST00000454908
  CDS Start-End: 1-17
ggtacaactggaacgac

SEQ ID NO: 142055 - DNA, 17 bp, Homo sapiens
  Payload ID: 7939
  Gene Symbol: IGHD1-1
  Gene Name: immunoglobulin heavy diversity 1-1
  ENST ID: ENST00000633210
  CDS Start-End: 1-17
ggtacaactggaacgac

SEQ ID NO: 142056 - DNA, 17 bp, Homo sapiens
  Payload ID: 7940
  Gene Symbol: IGHD1-14
  Gene Name: immunoglobulin heavy diversity 1-14 (non-functional)
  ENST ID: ENST00000451044
  CDS Start-End: 1-17
ggtataaccggaaccac

SEQ ID NO: 142057 - DNA, 17 bp, Homo sapiens
  Payload ID: 7940
  Gene Symbol: IGHD1-14
  Gene Name: immunoglobulin heavy diversity 1-14 (non-functional)
  ENST ID: ENST00000631884
  CDS Start-End: 1-17
ggtataaccggaaccac

SEQ ID NO: 142058 - DNA, 17 bp, Homo sapiens
  Payload ID: 7941
  Gene Symbol: IGHD1-20
  Gene Name: immunoglobulin heavy diversity 1-20
  ENST ID: ENST00000450276
  CDS Start-End: 1-17
ggtataactggaacgac

SEQ ID NO: 142059 - DNA, 17 bp, Homo sapiens
  Payload ID: 7941
  Gene Symbol: IGHD1-20
  Gene Name: immunoglobulin heavy diversity 1-20
  ENST ID: ENST00000632968
  CDS Start-End: 1-17
ggtataactggaacgac

SEQ ID NO: 142060 - DNA, 20 bp, Homo sapiens
  Payload ID: 7942
  Gene Symbol: IGHD1-26
  Gene Name: immunoglobulin heavy diversity 1-26
  ENST ID: ENST00000390567
  CDS Start-End: 1-20
ggtatagtgggagctactac

SEQ ID NO: 142061 - DNA, 20 bp, Homo sapiens
  Payload ID: 7942
  Gene Symbol: IGHD1-26
  Gene Name: immunoglobulin heavy diversity 1-26
  ENST ID: ENST00000633009
  CDS Start-End: 1-20
ggtatagtgggagctactac

SEQ ID NO: 142062 - DNA, 17 bp, Homo sapiens
  Payload ID: 7943
  Gene Symbol: IGHD1-7
  Gene Name: immunoglobulin heavy diversity 1-7
  ENST ID: ENST00000430425
  CDS Start-End: 1-17
ggtataactggaactac

SEQ ID NO: 142063 - DNA, 17 bp, Homo sapiens
  Payload ID: 7943
  Gene Symbol: IGHD1-7
  Gene Name: immunoglobulin heavy diversity 1-7
  ENST ID: ENST00000632304
  CDS Start-End: 1-17
ggtataactggaactac

SEQ ID NO: 142064 - DNA, 31 bp, Homo sapiens
  Payload ID: 7944
  Gene Symbol: IGHD2OR15-2A
  Gene Name: immunoglobulin heavy diversity 2/OR15-2A (non-functional)
  ENST ID: ENST00000603077
  CDS Start-End: 1-31
agaatattgtaatagtactactttctatgcc

SEQ ID NO: 142065 - DNA, 31 bp, Homo sapiens; identical to SEQ ID NO: 142064
  Payload ID: 7945
  Gene Symbol: IGHD2OR15-2B
  Gene Name: immunoglobulin heavy diversity 2/OR15-2B (non-functional)
  ENST ID: ENST00000604102
  CDS Start-End: 1-31

SEQ ID NO: 142066 - DNA, 31 bp, Homo sapiens
  Payload ID: 7946
  Gene Symbol: IGHD2-15
  Gene Name: immunoglobulin heavy diversity 2-15
  ENST ID: ENST00000390578
  CDS Start-End: 1-31
aggatattgtagtggtggtagctgctactcc

SEQ ID NO: 142067 - DNA, 31 bp, Homo sapiens; identical to SEQ ID NO: 142066
  Payload ID: 7946
  Gene Symbol: IGHD2-15
  Gene Name: immunoglobulin heavy diversity 2-15
  ENST ID: ENST00000632473
  CDS Start-End: 1-31

SEQ ID NO: 142068 - DNA, 31 bp, Homo sapiens
  Payload ID: 7947
  Gene Symbol: IGHD2-2
  Gene Name: immunoglobulin heavy diversity 2-2
  ENST ID: ENST00000390591
  CDS Start-End: 1-31
aggatattgtagtagtaccagctgctatgcc

SEQ ID NO: 142069 - DNA, 31 bp, Homo sapiens; identical to SEQ ID NO: 142068
  Payload ID: 7947
  Gene Symbol: IGHD2-2
  Gene Name: immunoglobulin heavy diversity 2-2
  ENST ID: ENST00000631803
  CDS Start-End: 1-31

SEQ ID NO: 142070 - DNA, 28 bp, Homo sapiens
  Payload ID: 7948
  Gene Symbol: IGHD2-21
  Gene Name: immunoglobulin heavy diversity 2-21
  ENST ID: ENST00000390572
  CDS Start-End: 1-28
agcatattgtggtggtgactgctattcc

SEQ ID NO: 142071 - DNA, 28 bp, Homo sapiens
  Payload ID: 7948
  Gene Symbol: IGHD2-21
  Gene Name: immunoglobulin heavy diversity 2-21
  ENST ID: ENST00000632619
  CDS Start-End: 1-28
agcatattgtggtggtgactgctattcc

SEQ ID NO: 142072 - DNA, 31 bp, Homo sapiens
  Payload ID: 7949
  Gene Symbol: IGHD2-8
  Gene Name: immunoglobulin heavy diversity 2-8
  ENST ID: ENST00000390585
  CDS Start-End: 1-31
aggatattgtactaatggtgtatgctatacc

SEQ ID NO: 142073 - DNA, 31 bp, Homo sapiens; identical to SEQ ID NO: 142072
  Payload ID: 7949
  Gene Symbol: IGHD2-8
  Gene Name: immunoglobulin heavy diversity 2-8
  ENST ID: ENST00000633504
  CDS Start-End: 1-31

SEQ ID NO: 142074 - DNA, 31 bp, Homo sapiens
  Payload ID: 7950
  Gene Symbol: IGHD3OR15-3A
  Gene Name: immunoglobulin heavy diversity 3/OR15-3A (non-functional)
  ENST ID: ENST00000604950
  CDS Start-End: 1-31
gtattatgatttttggactggttattatacc

SEQ ID NO: 142075 - DNA, 31 bp, Homo sapiens; identical to SEQ ID NO: 142074
  Payload ID: 7951
  Gene Symbol: IGHD3OR15-3B
  Gene Name: immunoglobulin heavy diversity 3/OR15-3B (non-functional)
  ENST ID: ENST00000603935
  CDS Start-End: 1-31

SEQ ID NO: 142076 - DNA, 31 bp, Homo sapiens
  Payload ID: 7952
  Gene Symbol: IGHD3-10
  Gene Name: immunoglobulin heavy diversity 3-10
  ENST ID: ENST00000390583
  CDS Start-End: 1-30
gtattactatggttcggggagttattataac

SEQ ID NO: 142077 - DNA, 31 bp, Homo sapiens; identical to SEQ ID NO: 142076
  Payload ID: 7952
  Gene Symbol: IGHD3-10
  Gene Name: immunoglobulin heavy diversity 3-10
  ENST ID: ENST00000632609
  CDS Start-End: 1-30

SEQ ID NO: 142078 - DNA, 37 bp, Homo sapiens
  Payload ID: 7953
  Gene Symbol: IGHD3-16
  Gene Name: immunoglobulin heavy diversity 3-16
  ENST ID: ENST00000390577
  CDS Start-End: 1-37
gtattatgattacgtttgggggagttatcgttatacc

SEQ ID NO: 142079 - DNA, 37 bp, Homo sapiens; identical to SEQ ID NO: 142078
  Payload ID: 7953
  Gene Symbol: IGHD3-16
  Gene Name: immunoglobulin heavy diversity 3-16
  ENST ID: ENST00000633379
  CDS Start-End: 1-37

SEQ ID NO: 142080 - DNA, 31 bp, Homo sapiens
  Payload ID: 7954
  Gene Symbol: IGHD3-22
  Gene Name: immunoglobulin heavy diversity 3-22
  ENST ID: ENST00000390571
  CDS Start-End: 1-31
gtattactatgatagtagtggttattactac

SEQ ID NO: 142081 - DNA, 31 bp, Homo sapiens; identical to SEQ ID NO: 142080
  Payload ID: 7954
  Gene Symbol: IGHD3-22
  Gene Name: immunoglobulin heavy diversity 3-22
  ENST ID: ENST00000633765
  CDS Start-End: 1-31

SEQ ID NO: 142082 - DNA, 31 bp, Homo sapiens
  Payload ID: 7955
  Gene Symbol: IGHD3-3
  Gene Name: immunoglobulin heavy diversity 3-3
  ENST ID: ENST00000390590
  CDS Start-End: 1-31
gtattacgatttttggagtggttattatacc

SEQ ID NO: 142083 - DNA, 31 bp, Homo sapiens; identical to SEQ ID NO: 142082
  Payload ID: 7955
  Gene Symbol: IGHD3-3
  Gene Name: immunoglobulin heavy diversity 3-3
  ENST ID: ENST00000633353
  CDS Start-End: 1-31

SEQ ID NO: 142084 - DNA, 31 bp, Homo sapiens
  Payload ID: 7956
  Gene Symbol: IGHD3-9
  Gene Name: immunoglobulin heavy diversity 3-9
  ENST ID: ENST00000390584
  CDS Start-End: 1-30
gtattacgatattttgactggttattataac

SEQ ID NO: 142085 - DNA, 31 bp, Homo sapiens; identical to SEQ ID NO: 142084
  Payload ID: 7956
  Gene Symbol: IGHD3-9
  Gene Name: immunoglobulin heavy diversity 3-9
  ENST ID: ENST00000632911
  CDS Start-End: 1-30

SEQ ID NO: 142086 - DNA, 19 bp, Homo sapiens
  Payload ID: 7957
  Gene Symbol: IGHD4OR15-4A
  Gene Name: immunoglobulin heavy diversity 4/OR15-4A (non-functional)
  ENST ID: ENST00000603326
  CDS Start-End: 1-19
tgactatggtgctaactac

SEQ ID NO: 142087 - DNA, 19 bp, Homo sapiens
  Payload ID: 7958
  Gene Symbol: IGHD4OR15-4B
  Gene Name: immunoglobulin heavy diversity 4/OR15-4B (non-functional)
  ENST ID: ENST00000603693
  CDS Start-End: 1-19
tgactatggtgctaactac

SEQ ID NO: 142088 - DNA, 16 bp, Homo sapiens
  Payload ID: 7959
  Gene Symbol: IGHD4-11
  Gene Name: immunoglobulin heavy diversity 4-11 (non-functional)
  ENST ID: ENST00000431440
  CDS Start-End: 1-16
tgactacagtaactac

SEQ ID NO: 142089 - DNA, 16 bp, Homo sapiens
  Payload ID: 7959
  Gene Symbol: IGHD4-11
  Gene Name: immunoglobulin heavy diversity 4-11 (non-functional)
  ENST ID: ENST00000634154
  CDS Start-End: 1-16
tgactacagtaactac

SEQ ID NO: 142090 - DNA, 16 bp, Homo sapiens
  Payload ID: 7960
  Gene Symbol: IGHD4-17
  Gene Name: immunoglobulin heavy diversity 4-17
  ENST ID: ENST00000431870
  CDS Start-End: 1-16
tgactacggtgactac

SEQ ID NO: 142091 - DNA, 16 bp, Homo sapiens
  Payload ID: 7960
  Gene Symbol: IGHD4-17
  Gene Name: immunoglobulin heavy diversity 4-17
  ENST ID: ENST00000633010
  CDS Start-End: 1-16
tgactacggtgactac

SEQ ID NO: 142092 - DNA, 19 bp, Homo sapiens
  Payload ID: 7961
  Gene Symbol: IGHD4-23
  Gene Name: immunoglobulin heavy diversity 4-23 (non-functional)
  ENST ID: ENST00000437320
  CDS Start-End: 1-19
tgactacggtggtaactcc

SEQ ID NO: 142093 - DNA, 19 bp, Homo sapiens
  Payload ID: 7961
  Gene Symbol: IGHD4-23
  Gene Name: immunoglobulin heavy diversity 4-23 (non-functional)
  ENST ID: ENST00000633030
  CDS Start-End: 1-19
tgactacggtggtaactcc

SEQ ID NO: 142094 - DNA, 16 bp, Homo sapiens
  Payload ID: 7962
  Gene Symbol: IGHD4-4
  Gene Name: immunoglobulin heavy diversity 4-4
  ENST ID: ENST00000414852
  CDS Start-End: 1-16
tgactacagtaactac

SEQ ID NO: 142095 - DNA, 16 bp, Homo sapiens
  Payload ID: 7962
  Gene Symbol: IGHD4-4
  Gene Name: immunoglobulin heavy diversity 4-4
  ENST ID: ENST00000634085
  CDS Start-End: 1-16
tgactacagtaactac

SEQ ID NO: 142096 - DNA, 23 bp, Homo sapiens
  Payload ID: 7963
  Gene Symbol: IGHD5OR15-5A
  Gene Name: immunoglobulin heavy diversity 5/OR15-5A (non-functional)
  ENST ID: ENST00000604642
  CDS Start-End: 1-23
gtggatatagtgtctacgattac

SEQ ID NO: 142097 - DNA, 23 bp, Homo sapiens
  Payload ID: 7964
  Gene Symbol: IGHD5OR15-5B
  Gene Name: immunoglobulin heavy diversity 5/OR15-5B (non-functional)
  ENST ID: ENST00000604446
  CDS Start-End: 1-23
gtggatatagtgtctacgattac

SEQ ID NO: 142098 - DNA, 23 bp, Homo sapiens
  Payload ID: 7965
  Gene Symbol: IGHD5-12
  Gene Name: immunoglobulin heavy diversity 5-12
  ENST ID: ENST00000390581
  CDS Start-End: 1-23
gtggatatagtggctacgattac

SEQ ID NO: 142099 - DNA, 23 bp, Homo sapiens
  Payload ID: 7965
  Gene Symbol: IGHD5-12
  Gene Name: immunoglobulin heavy diversity 5-12
  ENST ID: ENST00000631895
  CDS Start-End: 1-23
gtggatatagtggctacgattac

SEQ ID NO: 142100 - DNA, 20 bp, Homo sapiens
  Payload ID: 7966
  Gene Symbol: IGHD5-18
  Gene Name: immunoglobulin heavy diversity 5-18
  ENST ID: ENST00000390575
  CDS Start-End: 1-20
gtggatacagctatggttac

SEQ ID NO: 142101 - DNA, 20 bp, Homo sapiens
  Payload ID: 7966
  Gene Symbol: IGHD5-18
  Gene Name: immunoglobulin heavy diversity 5-18
  ENST ID: ENST00000631871
  CDS Start-End: 1-20
gtggatacagctatggttac

SEQ ID NO: 142102 - DNA, 20 bp, Homo sapiens
  Payload ID: 7967
  Gene Symbol: IGHD5-24
  Gene Name: immunoglobulin heavy diversity 5-24 (non-functional)
  ENST ID: ENST00000390569
  CDS Start-End: 1-20
gtagagatggctacaattac

SEQ ID NO: 142103 - DNA, 20 bp, Homo sapiens
  Payload ID: 7967
  Gene Symbol: IGHD5-24
  Gene Name: immunoglobulin heavy diversity 5-24 (non-functional)
  ENST ID: ENST00000632963
  CDS Start-End: 1-20
gtagagatggctacaattac

SEQ ID NO: 142104 - DNA, 20 bp, Homo sapiens
  Payload ID: 7968
  Gene Symbol: IGHD5-5
  Gene Name: immunoglobulin heavy diversity 5-5
  ENST ID: ENST00000390588
  CDS Start-End: 1-20
gtggatacagctatggttac

SEQ ID NO: 142105 - DNA, 20 bp, Homo sapiens
  Payload ID: 7968
  Gene Symbol: IGHD5-5
  Gene Name: immunoglobulin heavy diversity 5-5
  ENST ID: ENST00000633968
  CDS Start-End: 1-20
gtggatacagctatggttac

SEQ ID NO: 142106 - DNA, 21 bp, Homo sapiens
  Payload ID: 7969
  Gene Symbol: IGHD6-13
  Gene Name: immunoglobulin heavy diversity 6-13
  ENST ID: ENST00000390580
  CDS Start-End: 1-21
gggtatagcagcagctggtac

SEQ ID NO: 142107 - DNA, 21 bp, Homo sapiens
  Payload ID: 7969
  Gene Symbol: IGHD6-13
  Gene Name: immunoglobulin heavy diversity 6-13
  ENST ID: ENST00000632859
  CDS Start-End: 1-21
gggtatagcagcagctggtac

SEQ ID NO: 142108 - DNA, 21 bp, Homo sapiens
  Payload ID: 7970
  Gene Symbol: IGHD6-19
  Gene Name: immunoglobulin heavy diversity 6-19
  ENST ID: ENST00000390574
  CDS Start-End: 1-21
gggtatagcagtggctggtac

SEQ ID NO: 142109 - DNA, 21 bp, Homo sapiens
  Payload ID: 7970
  Gene Symbol: IGHD6-19
  Gene Name: immunoglobulin heavy diversity 6-19
  ENST ID: ENST00000633159
  CDS Start-End: 1-21
gggtatagcagtggctggtac

SEQ ID NO: 142110 - DNA, 18 bp, Homo sapiens
  Payload ID: 7971
  Gene Symbol: IGHD6-25
  Gene Name: immunoglobulin heavy diversity 6-25
  ENST ID: ENST00000452198
  CDS Start-End: 1-18
gggtatagcagcggctac

SEQ ID NO: 142111 - DNA, 18 bp, Homo sapiens
  Payload ID: 7971
  Gene Symbol: IGHD6-25
  Gene Name: immunoglobulin heavy diversity 6-25
  ENST ID: ENST00000634070
  CDS Start-End: 1-18
gggtatagcagcggctac

SEQ ID NO: 142112 - DNA, 18 bp, Homo sapiens
  Payload ID: 7972
  Gene Symbol: IGHD6-6
  Gene Name: immunoglobulin heavy diversity 6-6
  ENST ID: ENST00000454691
  CDS Start-End: 1-18
gagtatagcagctcgtcc

SEQ ID NO: 142113 - DNA, 18 bp, Homo sapiens
  Payload ID: 7972
  Gene Symbol: IGHD6-6
  Gene Name: immunoglobulin heavy diversity 6-6
  ENST ID: ENST00000632542
  CDS Start-End: 1-18
gagtatagcagctcgtcc

SEQ ID NO: 142114 - DNA, 11 bp, Homo sapiens
  Payload ID: 7973
  Gene Symbol: IGHD7-27
  Gene Name: immunoglobulin heavy diversity 7-27
  ENST ID: ENST00000439842
  CDS Start-End: 1-11
ctaactgggga

SEQ ID NO: 142115 - DNA, 11 bp, Homo sapiens
  Payload ID: 7973
  Gene Symbol: IGHD7-27
  Gene Name: immunoglobulin heavy diversity 7-27
  ENST ID: ENST00000632524
  CDS Start-End: 1-11
ctaactgggga

SEQ ID NO: 142116 - DNA, 52 bp, Homo sapiens
  Payload ID: 7974
  Gene Symbol: IGHJ1
  Gene Name: immunoglobulin heavy joining 1
  ENST ID: ENST00000390565
  CDS Start-End: 1-52
gctgaatacttccagcactggggccagggcaccctggtcaccgtctcctcag

SEQ ID NO: 142117 - DNA, 52 bp, Homo sapiens; identical to SEQ ID NO: 142116
  Payload ID: 7974
  Gene Symbol: IGHJ1
  Gene Name: immunoglobulin heavy joining 1
  ENST ID: ENST00000634062
  CDS Start-End: 1-52

SEQ ID NO: 142118 - DNA, 52 bp, Homo sapiens
  Payload ID: 7975
  Gene Symbol: IGHJ2
  Gene Name: immunoglobulin heavy joining 2
  ENST ID: ENST00000390564
  CDS Start-End: 1-52
tactggtacttcgatctctggggccgtggcaccctggtcactgtctcctcag

SEQ ID NO: 142119 - DNA, 53 bp, Homo sapiens
  Payload ID: 7975
  Gene Symbol: IGHJ2
  Gene Name: immunoglobulin heavy joining 2
  ENST ID: ENST00000632178
  CDS Start-End: 1-53
ctactggtacttcgatctctggggccgtggcaccctggtcactgtctcctcag

SEQ ID NO: 142120 - DNA, 49 bp, Homo sapiens
  Payload ID: 7976
  Gene Symbol: IGHJ3
  Gene Name: immunoglobulin heavy joining 3
  ENST ID: ENST00000463911
  CDS Start-End: 1-49
gatgcttttgatatctggggccaagggacaatggtcaccgtctcttcag

SEQ ID NO: 142121 - DNA, 50 bp, Homo sapiens
  Payload ID: 7976
  Gene Symbol: IGHJ3
  Gene Name: immunoglobulin heavy joining 3
  ENST ID: ENST00000633896
  CDS Start-End: 1-50
tgatgcttttgatatctggggccaagggacaatggtcaccgtctcttcag

SEQ ID NO: 142122 - DNA, 46 bp, Homo sapiens
  Payload ID: 7977
  Gene Symbol: IGHJ4
  Gene Name: immunoglobulin heavy joining 4
  ENST ID: ENST00000461719
  CDS Start-End: 1-46
tactttgactactggggccagggaaccctggtcaccgtctcctcag

SEQ ID NO: 142123 - DNA, 48 bp, Homo sapiens
  Payload ID: 7977
  Gene Symbol: IGHJ4
  Gene Name: immunoglobulin heavy joining 4
  ENST ID: ENST00000631521
  CDS Start-End: 1-48
actactttgactactggggccagggaaccctggtcaccgtctcctcag

SEQ ID NO: 142124 - DNA, 49 bp, Homo sapiens
  Payload ID: 7978
  Gene Symbol: IGHJ5
  Gene Name: immunoglobulin heavy joining 5
  ENST ID: ENST00000488476
  CDS Start-End: 1-49
aactggttcgacccctggggccagggaaccctggtcaccgtctcctcag

SEQ ID NO: 142125 - DNA, 51 bp, Homo sapiens
  Payload ID: 7978
  Gene Symbol: IGHJ5
  Gene Name: immunoglobulin heavy joining 5
  ENST ID: ENST00000633501
  CDS Start-End: 1-51
acaactggttcgacccctggggccagggaaccctggtcaccgtctcctcag

SEQ ID NO: 142126 - DNA, 61 bp, Homo sapiens
  Payload ID: 7979
  Gene Symbol: IGHJ6
  Gene Name: immunoglobulin heavy joining 6
  ENST ID: ENST00000390560
  CDS Start-End: 1-61
tactactactactactacatggacgtctggggcaaagggaccacggtcaccgtctcctcag

SEQ ID NO: 142127 - DNA, 63 bp, Homo sapiens
  Payload ID: 7979
  Gene Symbol: IGHJ6
  Gene Name: immunoglobulin heavy joining 6
  ENST ID: ENST00000631705
  CDS Start-End: 1-63
attactactactactactacatggacgtctggggcaaagggaccacggtcaccgtctcctcag

SEQ ID NO: 142128 - DNA, 353 bp, Homo sapiens
  Payload ID: 7980
  Gene Symbol: IGHV1OR15-1
  Gene Name: immunoglobulin heavy variable 1/OR15-1 (non-functional)
  ENST ID: ENST00000604066
  CDS Start-End: 1-353
atggactggacctggaggatcctcttcttggtggcagcagctacaggtgcccactcccaggtgcagctggtgcagtctggggctgaggtgaagaagcctggggcctcagtgaaggtctcctgcaaggcttctggatacatcttcaccgactactatatgcactgggtgcgacaggcccctggacaagagcttgggtggatgggacggatcaaccctaacagtggtggcacaaactatgcacagaagtttcagggcagagtcaccatgaccagggacacgtccatcagcacagcctacacggagctgagcagcctgagatctgaggacacggccacgtattactgtgcgagaga

SEQ ID NO: 142129 - DNA, 353 bp, Homo sapiens
  Payload ID: 7981
  Gene Symbol: IGHV1OR15-9
  Gene Name: immunoglobulin heavy variable 1/OR15-9 (non-functional)
  ENST ID: ENST00000338912
  CDS Start-End: 1-353
atgggctggacttggaggatcctgtttttggtggtcatagctgcaggtgcccagtcccaggtacagctgatgcagtctggggctgaggtgaagaagcctggggcctcagtgaggatctcctgcaaggcttctggatacaccttcaccagctactgtatgcactgggtgtgccaggcccatgcacaagggcttgagtggatgggattggtgtgccctagtgatggcagcacaagctatgcacagaagttccagggcagagtcaccataaccagggacacatccatgggcacagcctacatggagctaagcagcctgagatctgaggacacggccatgtattactgtgtgagaga

SEQ ID NO: 142130 - DNA, 353 bp, Homo sapiens
  Payload ID: 7982
  Gene Symbol: IGHV1OR21-1
  Gene Name: immunoglobulin heavy variable 1/OR21-1 (non-functional)
  ENST ID: ENST00000622028
  CDS Start-End: 1-353
atggactggaattggaggatcctgtttttggtggtcatagctgcgggtgcccagtcccaggtacagctggtgcagtctggggctgaggtgaagaagcctggggcctcagtgaaggtctcctgcaaggcttctggatacaccatcaccagctactgtatgcactgggtgcaccaggtccatgcacaagggcttgagtggatgggattggtgtgccctagtgatggcagcacaagctatgcacagaagttccaggccagagtcaccataaccagggacacatccatgagcacagcctacatggagctaagcagtctgagatctgaggacacggccatgtattactgtgtgagaga

SEQ ID NO: 142131 - DNA, 410 bp, Homo sapiens
  Payload ID: 7983
  Gene Symbol: IGHV1-18
  Gene Name: immunoglobulin heavy variable 1-18
  ENST ID: ENST00000390605
  CDS Start-End: 60-410
gcatcacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgaga

SEQ ID NO: 142132 - DNA, 412 bp, Homo sapiens
  Payload ID: 7983
  Gene Symbol: IGHV1-18
  Gene Name: immunoglobulin heavy variable 1-18
  ENST ID: ENST00000633147
  CDS Start-End: 60-412
gcatcacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 142133 - DNA, 417 bp, Homo sapiens
  Payload ID: 7984
  Gene Symbol: IGHV1-2
  Gene Name: immunoglobulin heavy variable 1-2
  ENST ID: ENST00000390594
  CDS Start-End: 65-417
gagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgagaga

SEQ ID NO: 142134 - DNA, 417 bp, Homo sapiens; identical to SEQ ID NO: 142133
  Payload ID: 7984
  Gene Symbol: IGHV1-2
  Gene Name: immunoglobulin heavy variable 1-2
  ENST ID: ENST00000633350
  CDS Start-End: 65-417

SEQ ID NO: 142135 - DNA, 411 bp, Homo sapiens
  Payload ID: 7985
  Gene Symbol: IGHV1-24
  Gene Name: immunoglobulin heavy variable 1-24
  ENST ID: ENST00000390610
  CDS Start-End: 61-411
accatcacacaacagccacatccctcccctacagaagcccccagagcgcagcacctcaccatggactgcacctggaggatcctcttcttggtggcagcagctacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaaca

SEQ ID NO: 142136 - DNA, 413 bp, Homo sapiens
  Payload ID: 7985
  Gene Symbol: IGHV1-24
  Gene Name: immunoglobulin heavy variable 1-24
  ENST ID: ENST00000633490
  CDS Start-End: 61-413
accatcacacaacagccacatccctcccctacagaagcccccagagcgcagcacctcaccatggactgcacctggaggatcctcttcttggtggcagcagctacaggcacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaga

SEQ ID NO: 142137 - DNA, 395 bp, Homo sapiens
  Payload ID: 7986
  Gene Symbol: IGHV1-3
  Gene Name: immunoglobulin heavy variable 1-3
  ENST ID: ENST00000390595
  CDS Start-End: 43-395
ccacatccctcctcagaagcccccagagcacaacgcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaga

SEQ ID NO: 142138 - DNA, 395 bp, Homo sapiens; identical to SEQ ID NO: 142137
  Payload ID: 7986
  Gene Symbol: IGHV1-3
  Gene Name: immunoglobulin heavy variable 1-3
  ENST ID: ENST00000632977
  CDS Start-End: 43-395

SEQ ID NO: 142139 - DNA, 411 bp, Homo sapiens
  Payload ID: 7987
  Gene Symbol: IGHV1-45
  Gene Name: immunoglobulin heavy variable 1-45
  ENST ID: ENST00000390621
  CDS Start-End: 59-411
atcacccaacaaccacatccctcctctagagaatcccctgaaagcacagctcctcaccatggactggacctggagaatcctcttcttggtggcagcagtcacagatgcctactcccagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagata

SEQ ID NO: 142140 - DNA, 411 bp, Homo sapiens; identical to SEQ ID NO: 142139
  Payload ID: 7987
  Gene Symbol: IGHV1-45
  Gene Name: immunoglobulin heavy variable 1-45
  ENST ID: ENST00000631826
  CDS Start-End: 59-411

SEQ ID NO: 142141 - DNA, 655 bp, Homo sapiens
  Payload ID: 7988
  Gene Symbol: IGHV1-46
  Gene Name: immunoglobulin heavy variable 1-46
  ENST ID: ENST00000390622
  CDS Start-End: 305-655
atctgtggggacttgttcttcagtgaaaggatcctgtccgcaaacagaaatggagcaggacatgcatttcttcaagcaggattagggcttggaccatcagcatcccactcctgtgtggcagatgggacatctatcttctttctcaacctcgatcaggctttgaggtatgaaataatctgtctcatgaatatgcaaataaccttagatctactgaggtaaatatggatacatctgggccctgaaagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgaga

SEQ ID NO: 142142 - DNA, 657 bp, Homo sapiens
  Payload ID: 7988
  Gene Symbol: IGHV1-46
  Gene Name: immunoglobulin heavy variable 1-46
  ENST ID: ENST00000632105
  CDS Start-End: 305-657
atctgtggggacttgttcttcagtgaaaggatcctgtccgcaaacagaaatggagcaggacatgcatttcttcaagcaggattagggcttggaccatcagcatcccactcctgtgtggcagatgggacatctatcttctttctcaacctcgatcaggctttgaggtatgaaataatctgtctcatgaatatgcaaataaccttagatctactgaggtaaatatggatacatctgggccctgaaagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 142143 - DNA, 414 bp, Homo sapiens
  Payload ID: 7989
  Gene Symbol: IGHV1-58
  Gene Name: immunoglobulin heavy variable 1-58
  ENST ID: ENST00000390628
  CDS Start-End: 62-414
agcatcatccagaaaccacatccctccgctagagaagcccctgacggcacagttcctcactatggactggatttggaggatcctcttcttggtgggagcagcgacaggtgcccactcccaaatgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 142144 - DNA, 414 bp, Homo sapiens; identical to SEQ ID NO: 142143
  Payload ID: 7989
  Gene Symbol: IGHV1-58
  Gene Name: immunoglobulin heavy variable 1-58
  ENST ID: ENST00000632614
  CDS Start-End: 62-414

SEQ ID NO: 142145 - DNA, 412 bp, Homo sapiens
  Payload ID: 7990
  Gene Symbol: IGHV1-69
  Gene Name: immunoglobulin heavy variable 1-69
  ENST ID: ENST00000390633
  CDS Start-End: 62-412
agcatcacataacaaccacattcctcctctgaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgaga

SEQ ID NO: 142146 - DNA, 414 bp, Homo sapiens
  Payload ID: 7990
  Gene Symbol: IGHV1-69
  Gene Name: immunoglobulin heavy variable 1-69
  ENST ID: ENST00000632882
  CDS Start-End: 62-414
agcatcacataacaaccacattcctcctctgaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 142147 - DNA, 411 bp, Homo sapiens
  Payload ID: 7991
  Gene Symbol: IGHV1-69-2
  Gene Name: immunoglobulin heavy variable 1-69-2
  ENST ID: ENST00000624687
  CDS Start-End: 59-411
atcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 142148 - DNA, 411 bp, Homo sapiens
  Payload ID: 7991
  Gene Symbol: IGHV1-69-2
  Gene Name: immunoglobulin heavy variable 1-69-2
  ENST ID: ENST00000633446
  CDS Start-End: 59-411
atcacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 142149 - DNA, 358 bp, Homo sapiens
  Payload ID: 7992
  Gene Symbol: IGHV2OR16-5
  Gene Name: immunoglobulin heavy variable 2/OR16-5 (non-functional)
  ENST ID: ENST00000567458
  CDS Start-End: 1-358
atggacacgttttgctccacactcctgctgctgaccaccccttcctgggtcttgtcccaggtcaccttgaaggagtctggtcctgcgctggtgaaacccacagagaccctcacgctgacctgcactctctctgggttctcactcagcacttctggaatgggtatgagctggatccgtcagcccccagggaaggccctggagtggcttgctcacatttttttgaatgacaaaaaatcctacagcacgtctctgaagaacaggctcatcatctccaaggacacctccaaaagccaggtggtccttaccatgaccaacatggaccctgtggacacagccacgtattactgtgcatggagag

SEQ ID NO: 142150 - DNA, 381 bp, Homo sapiens
  Payload ID: 7993
  Gene Symbol: IGHV2-26
  Gene Name: immunoglobulin heavy variable 2-26
  ENST ID: ENST00000390611
  CDS Start-End: 25-381
gctcagtgactcctgtgccccaccatggacacactttgctacacactcctgctgctgaccaccccttcctgggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggata

SEQ ID NO: 142151 - DNA, 382 bp, Homo sapiens
  Payload ID: 7993
  Gene Symbol: IGHV2-26
  Gene Name: immunoglobulin heavy variable 2-26
  ENST ID: ENST00000632457
  CDS Start-End: 25-382
gctcagtgactcctgtgccccaccatggacacactttgctacacactcctgctgctgaccaccccttcctgggtcttgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatac

SEQ ID NO: 142152 - DNA, 378 bp, Homo sapiens
  Payload ID: 7994
  Gene Symbol: IGHV2-5
  Gene Name: immunoglobulin heavy variable 2-5
  ENST ID: ENST00000390597
  CDS Start-End: 21-378
agtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagac

SEQ ID NO: 142153 - DNA, 378 bp, Homo sapiens; identical to SEQ ID NO: 142152
  Payload ID: 7994
  Gene Symbol: IGHV2-5
  Gene Name: immunoglobulin heavy variable 2-5
  ENST ID: ENST00000560724
  CDS Start-End: 21-378

SEQ ID NO: 142154 - DNA, 358 bp, Homo sapiens
  Payload ID: 7995
  Gene Symbol: IGHV2-70
  Gene Name: immunoglobulin heavy variable 2-70
  ENST ID: ENST00000617374
  CDS Start-End: 1-358
atggacatactttgttccacgctcctgctactgactgtcccgtcctgggtcttatcccaggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacggatac

SEQ ID NO: 142155 - DNA, 434 bp, Homo sapiens
  Payload ID: 7995
  Gene Symbol: IGHV2-70
  Gene Name: immunoglobulin heavy variable 2-70
  ENST ID: ENST00000632173
  CDS Start-End: 77-434
atctccaccagctccaccctcccctgggttcaaaagacgaggacagggcctcgctcagtgaatcctgctccccaccatggacatgctttgttccatgctcctgctactgactgtcccgtcttgggtcttatcccaggtcaccttgaaggagtctggtcctgcgctggtgaaacccacacagaccctcacgctgacctgcaccttctctgggttctcactcagcactactggaatgcgtgtgagctggatccgtcggcccccagggaaggccctggagtggcttgcacgcattgattgggatgatgataaatactgcagcacatctctgaagaccaggctcaccatctccaaggacacctccaaaaaccaggtggtccttacaatgaccaacatggaccctgtggacacagccacgtattactgtgcacggatac

SEQ ID NO: 142156 - DNA, 359 bp, Homo sapiens
  Payload ID: 7996
  Gene Symbol: IGHV3OR15-7
  Gene Name: immunoglobulin heavy variable 3/OR15-7 (pseudogene)
  ENST ID: ENST00000558565
  CDS Start-End: 1-359
atggagtttgggctgagctgggttttccttgttgctattttaaaaggtgtccagtgtgaggtgcagctggtggagtctgggggaggcttggtccagcctgggggttctctgagactctcatgtgcagcctctggattcaccttcagtgaccactacatgagctgggtccgccaggctcaagggaaagggctagagttggtaggtttaataagaaacaaagctaacagttacacgacagaatatgctgcgtctgtgaaaggcagacttaccatctcaagagaggattcaaagaacacgctgtatctgcaaatgagcaacctgaaaaccgaggacttggccgtgtattactgtgctagaga

SEQ ID NO: 142157 - DNA, 350 bp, Homo sapiens
  Payload ID: 7997
  Gene Symbol: IGHV3OR16-10
  Gene Name: immunoglobulin heavy variable 3/OR16-10 (non-functional)
  ENST ID: ENST00000425181
  CDS Start-End: 1-350
atggagtttgtgctgagctgggttttccttgttgctatattaaaaggtgtccagtgtgaggttcagctggtgcagtctgggggaggcttggtacatcctggggggtccctgagactctcctgtgcaggctctggattcaccttcagtagctatgctatgcactgggttcgccaggctccaggaaaaggtctggagtgggtatcagctattggtactggtggtggcacatactatgcagactccgtgaagggccgattcaccatctccagagacaatgccaagaactccttgtatcttcaaatgaacagcctgagagccgaggacatggctgtgtattactgtgcaagaga

SEQ ID NO: 142158 - DNA, 353 bp, Homo sapiens
  Payload ID: 7998
  Gene Symbol: IGHV3OR16-12
  Gene Name: immunoglobulin heavy variable 3/OR16-12 (non-functional)
  ENST ID: ENST00000570121
  CDS Start-End: 1-353
atggagtttgagctcagctgggttttccttgttgctattttacaaggtgtccactgtgaggtgcagctggtagagtctgggagaggcttggcccagcctggggggtacctaaaactctccggtgcagcctctggattcaccgtcggtagctggtacatgagctggatccaccaggctccagggaagggtctggagtgggtctcatacattagtagtagtggttgtagcacaaactacgcagactctgtgaagggcagattcaccatctccacagacaactcaaagaacacgctctacctgcaaatgaacagcctgagagtggaggacacggccgtgtattactgtgcaagaga

SEQ ID NO: 142159 - DNA, 353 bp, Homo sapiens
  Payload ID: 7999
  Gene Symbol: IGHV3OR16-13
  Gene Name: immunoglobulin heavy variable 3/OR16-13 (non-functional)
  ENST ID: ENST00000562905
  CDS Start-End: 1-353
atggagtttgggctgagctgggttttccttgttgctattttaaaaggtgtccagtgtgaggtgcagctggtggagtctgggggaggcttagtacagcctggagggtccctgagactctcctgtgcagcctctggattcaccttcagtagctactggatgcactgggtccgccaagctccagggaaggggctggtgtgggtctcacgtattaatagtgatgggagtagcacaagctacgcagactccatgaagggccaattcaccatctccagagacaatgctaagaacacgctgtatctgcaaatgaacagtctgagagctgaggacatggctgtgtattactgtactagaga

SEQ ID NO: 142160 - DNA, 349 bp, Homo sapiens
  Payload ID: 8000
  Gene Symbol: IGHV3OR16-8
  Gene Name: immunoglobulin heavy variable 3/OR16-8 (non-functional)
  ENST ID: ENST00000565407
  CDS Start-End: 1-349
atggagtttgggctgaactgggttttccttgttgctattataaaaggtgcccagtgtgaggtgcagctggtggagtctgggggaggcttggtacagcctggggggtccctgagactgtcctgtccagcctctggattcaccttcagtaaccactacatgagctgggtccgccaggctccagggaagggactggagtgggtttcatacattagtggtgatagtggttacacaaactacgcagactctgtgaagggccgattcaccatctccagggacaacgccaataactcaccgtatctgcaaatgaacagcctgagagctgaggacacggctgtgtattactgtgtga

SEQ ID NO: 142161 - DNA, 294 bp, Homo sapiens
  Payload ID: 8001
  Gene Symbol: IGHV3OR16-9
  Gene Name: immunoglobulin heavy variable 3/OR16-9 (non-functional)
  ENST ID: ENST00000354689
  CDS Start-End: 1-294
gaggtgcagctggtggagtctggaggaggcttggtacagcctggggggtccctgagactctcctgtgcagcctctggattcaccttcagtaaccactacacgagctgggtccgccaggctccagggaagggactggagtgggtttcatacagtagtggtaatagtggttacacaaactacgcagactctgtgaaaggccgattcaccatctccagggacaacgccaagaactcactgtatctgcaaatgaacagcctgagagccgaggacacggctgtgtattactgtgtgaaa

SEQ ID NO: 142162 - DNA, 288 bp, Homo sapiens
  Payload ID: 8001
  Gene Symbol: IGHV3OR16-9
  Gene Name: immunoglobulin heavy variable 3/OR16-9 (non-functional)
  ENST ID: ENST00000558425
  CDS Start-End: 1-288
gaggtgcagctggtggagtctggaggaggcttggtacagcctggggggtccctgagactctcctgtgcagcctctggattcaccttcagtaaccactacacgagctgggtccgccaggctccagggaagggactggagtgggtttcatacagtagtggtaatagtggttacacaaactacgcagactctgtgaaaggccgattcaccatctccagggacaacgccaagaactcactgtatctgcaaatgaacagcctgagagccgaggacacggctgtgtattactgt

SEQ ID NO: 142163 - DNA, 473 bp, Homo sapiens
  Payload ID: 8002
  Gene Symbol: IGHV3-11
  Gene Name: immunoglobulin heavy variable 3-11 (gene/pseudogene)
  ENST ID: ENST00000390601
  CDS Start-End: 121-473
ctccctctgctgataaaaaccagccgagcccagaccctgcagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtagtagttacacaaactacgcagactctgtgaagggccgattcaccatctccagagacaacgccaagaactcactgtatctgcaaatgaacagcctgagagccgaggacacggctgtgtattactgtgcgagaga

SEQ ID NO: 142164 - DNA, 473 bp, Homo sapiens; identical to SEQ ID NO: 142163
  Payload ID: 8002
  Gene Symbol: IGHV3-11
  Gene Name: immunoglobulin heavy variable 3-11 (gene/pseudogene)
  ENST ID: ENST00000634015
  CDS Start-End: 121-473

SEQ ID NO: 142165 - DNA, 430 bp, Homo sapiens
  Payload ID: 8003
  Gene Symbol: IGHV3-13
  Gene Name: immunoglobulin heavy variable 3-13
  ENST ID: ENST00000390602
  CDS Start-End: 81-430
agctctgggagtggagccccagccttgggattcccaagtgtttgtattcagtgatcaggactgaacacacaggactcaccatggagttggggctgagctgggttttccttgttgctatattagaaggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacccatactatccaggctccgtgaagggccgattcaccatctccagagaaaatgccaagaactccttgtatcttcaaatgaacagcctgagagccggggacacggctgtgtattactgtgcaagaga

SEQ ID NO: 142166 - DNA, 430 bp, Homo sapiens; identical to SEQ ID NO: 142165
  Payload ID: 8003
  Gene Symbol: IGHV3-13
  Gene Name: immunoglobulin heavy variable 3-13
  ENST ID: ENST00000631975
  CDS Start-End: 81-430

SEQ ID NO: 142167 - DNA, 437 bp, Homo sapiens
  Payload ID: 8004
  Gene Symbol: IGHV3-15
  Gene Name: immunoglobulin heavy variable 3-15
  ENST ID: ENST00000390603
  CDS Start-End: 81-437
agctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccaca

SEQ ID NO: 142168 - DNA, 439 bp, Homo sapiens
  Payload ID: 8004
  Gene Symbol: IGHV3-15
  Gene Name: immunoglobulin heavy variable 3-15
  ENST ID: ENST00000632959
  CDS Start-End: 81-439
agctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 142169 - DNA, 425 bp, Homo sapiens
  Payload ID: 8005
  Gene Symbol: IGHV3-16
  Gene Name: immunoglobulin heavy variable 3-16 (non-functional)
  ENST ID: ENST00000390604
  CDS Start-End: 75-425
agccctgggagagaagccccagccctgggattctcaggtgtttctattgggtcaacagcaataaacaaattaccatggaatttgggctgagctgggtttttcttgctggtattttaaaaggtgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgaga

SEQ ID NO: 142170 - DNA, 425 bp, Homo sapiens; identical to SEQ ID NO: 142169
  Payload ID: 8005
  Gene Symbol: IGHV3-16
  Gene Name: immunoglobulin heavy variable 3-16 (non-functional)
  ENST ID: ENST00000631755
  CDS Start-End: 75-425

SEQ ID NO: 142171 - DNA, 415 bp, Homo sapiens
  Payload ID: 8006
  Gene Symbol: IGHV3-20
  Gene Name: immunoglobulin heavy variable 3-20
  ENST ID: ENST00000390606
  CDS Start-End: 63-415
ccagccctgagattcccacgtgtttccattcagtgatcagcactgaacacagaggactcgccatggagtttgggctgagctgggttttccttgttgctattttaaaaggtgtccagtgtgaggtgcagctggtggagtctgggggaggtgtggtacggcctggggggtccctgagactctcctttgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaga

SEQ ID NO: 142172 - DNA, 415 bp, Homo sapiens; identical to SEQ ID NO: 142171
  Payload ID: 8006
  Gene Symbol: IGHV3-20
  Gene Name: immunoglobulin heavy variable 3-20
  ENST ID: ENST00000632076
  CDS Start-End: 63-415

SEQ ID NO: 142173 - DNA, 430 bp, Homo sapiens
  Payload ID: 8007
  Gene Symbol: IGHV3-21
  Gene Name: immunoglobulin heavy variable 3-21
  ENST ID: ENST00000390607
  CDS Start-End: 80-430
agctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgaga

SEQ ID NO: 142174 - DNA, 432 bp, Homo sapiens
  Payload ID: 8007
  Gene Symbol: IGHV3-21
  Gene Name: immunoglobulin heavy variable 3-21
  ENST ID: ENST00000632980
  CDS Start-End: 80-432
agctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaga

SEQ ID NO: 142175 - DNA, 432 bp, Homo sapiens
  Payload ID: 8008
  Gene Symbol: IGHV3-23
  Gene Name: immunoglobulin heavy variable 3-23
  Uniprot ID: P01764
  ENST ID: ENST00000390609
  CDS Start-End: 80-432
agctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 142176 - DNA, 432 bp, Homo sapiens; identical to SEQ ID NO: 142175
  Payload ID: 8008
  Gene Symbol: IGHV3-23
  Gene Name: immunoglobulin heavy variable 3-23
  Uniprot ID: P01764
  ENST ID: ENST00000632630
  CDS Start-End: 80-432

SEQ ID NO: 142177 - DNA, 431 bp, Homo sapiens
  Payload ID: 8009
  Gene Symbol: IGHV3-30
  Gene Name: immunoglobulin heavy variable 3-30
  ENST ID: ENST00000603660
  CDS Start-End: 81-431
cagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaa

SEQ ID NO: 142178 - DNA, 431 bp, Homo sapiens; identical to SEQ ID NO: 142177
  Payload ID: 8009
  Gene Symbol: IGHV3-30
  Gene Name: immunoglobulin heavy variable 3-30
  ENST ID: ENST00000633400
  CDS Start-End: 81-431

SEQ ID NO: 142179 - DNA, 431 bp, Homo sapiens
  Payload ID: 8010
  Gene Symbol: IGHV3-33
  Gene Name: immunoglobulin heavy variable 3-33
  ENST ID: ENST00000390615
  CDS Start-End: 81-431
cagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaga

SEQ ID NO: 142180 - DNA, 420 bp, Homo sapiens
  Payload ID: 8010
  Gene Symbol: IGHV3-33
  Gene Name: immunoglobulin heavy variable 3-33
  ENST ID: ENST00000631807
  CDS Start-End: 68-420
cgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 142181 - DNA, 366 bp, Homo sapiens
  Payload ID: 8011
  Gene Symbol: IGHV3-35
  Gene Name: immunoglobulin heavy variable 3-35 (non-functional)
  ENST ID: ENST00000390617
  CDS Start-End: 16-366
aacaaacaaattaccatggaatttgggctgagctgggtttttcttgctgctattttaaaaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgaga

SEQ ID NO: 142182 - DNA, 368 bp, Homo sapiens
  Payload ID: 8011
  Gene Symbol: IGHV3-35
  Gene Name: immunoglobulin heavy variable 3-35 (non-functional)
  ENST ID: ENST00000632225
  CDS Start-End: 16-368
aacaaacaaattaccatggaatttgggctgagctgggtttttcttgctgctattttaaaaggtgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaa

SEQ ID NO: 142183 - DNA, 426 bp, Homo sapiens
  Payload ID: 8012
  Gene Symbol: IGHV3-38
  Gene Name: immunoglobulin heavy variable 3-38 (non-functional)
  ENST ID: ENST00000390618
  CDS Start-End: 79-426
ctctgggagtggagccccagccttgggattcccaggtgtttcccttcagtgatcaggactgaacacacacaactcatcatgcagtttgtgctgagctgggttttccttgttggtattttaaaaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatat

SEQ ID NO: 142184 - DNA, 427 bp, Homo sapiens
  Payload ID: 8012
  Gene Symbol: IGHV3-38
  Gene Name: immunoglobulin heavy variable 3-38 (non-functional)
  ENST ID: ENST00000631785
  CDS Start-End: 79-427
ctctgggagtggagccccagccttgggattcccaggtgtttcccttcagtgatcaggactgaacacacacaactcatcatgcagtttgtgctgagctgggttttccttgttggtattttaaaaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatata

SEQ ID NO: 142185 - DNA, 434 bp, Homo sapiens
  Payload ID: 8013
  Gene Symbol: IGHV3-43
  Gene Name: immunoglobulin heavy variable 3-43
  ENST ID: ENST00000434710
  CDS Start-End: 81-434
agctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagat

SEQ ID NO: 142186 - DNA, 435 bp, Homo sapiens
  Payload ID: 8013
  Gene Symbol: IGHV3-43
  Gene Name: immunoglobulin heavy variable 3-43
  ENST ID: ENST00000633040
  CDS Start-End: 81-435
agctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagata

SEQ ID NO: 142187 - DNA, 432 bp, Homo sapiens
  Payload ID: 8014
  Gene Symbol: IGHV3-48
  Gene Name: immunoglobulin heavy variable 3-48
  ENST ID: ENST00000390624
  CDS Start-End: 80-432
agctctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagaga

SEQ ID NO: 142188 - DNA, 432 bp, Homo sapiens; identical to SEQ ID NO: 142187
  Payload ID: 8014
  Gene Symbol: IGHV3-48
  Gene Name: immunoglobulin heavy variable 3-48
  ENST ID: ENST00000632296
  CDS Start-End: 80-432

SEQ ID NO: 142189 - DNA, 439 bp, Homo sapiens
  Payload ID: 8015
  Gene Symbol: IGHV3-49
  Gene Name: immunoglobulin heavy variable 3-49
  ENST ID: ENST00000390625
  CDS Start-End: 81-439
agctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 142190 - DNA, 342 bp, Homo sapiens
  Payload ID: 8015
  Gene Symbol: IGHV3-49
  Gene Name: immunoglobulin heavy variable 3-49
  ENST ID: ENST00000613477
  CDS Start-End: 1-342
gctattttaaaaggtgtccaatgtgaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacacagtgaggggaggt

SEQ ID NO: 142191 - DNA, 342 bp, Homo sapiens; identical to SEQ ID NO: 142190
  Payload ID: 8015
  Gene Symbol: IGHV3-49
  Gene Name: immunoglobulin heavy variable 3-49
  ENST ID: ENST00000614109
  CDS Start-End: 1-342

SEQ ID NO: 142192 - DNA, 439 bp, Homo sapiens; identical to SEQ ID NO: 142189
  Payload ID: 8015
  Gene Symbol: IGHV3-49
  Gene Name: immunoglobulin heavy variable 3-49
  ENST ID: ENST00000632211
  CDS Start-End: 81-439

SEQ ID NO: 142193 - DNA, 571 bp, Homo sapiens
  Payload ID: 8016
  Gene Symbol: IGHV3-53
  Gene Name: immunoglobulin heavy variable 3-53
  ENST ID: ENST00000390627
  CDS Start-End: 222-571
aataccaatctcccccaggacacttcatctgcacggagcccggcctctcctcagatgtcccaccccagagcttgctatatagtcggggacatgcaaatagggccctccctctgctgatgaaaaccagcccagctgaccctgcagctctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaga

SEQ ID NO: 142194 - DNA, 571 bp, Homo sapiens; identical to SEQ ID NO: 142193
  Payload ID: 8016
  Gene Symbol: IGHV3-53
  Gene Name: immunoglobulin heavy variable 3-53
  ENST ID: ENST00000633426
  CDS Start-End: 222-571

SEQ ID NO: 142195 - DNA, 431 bp, Homo sapiens
  Payload ID: 8017
  Gene Symbol: IGHV3-64
  Gene Name: immunoglobulin heavy variable 3-64
  ENST ID: ENST00000454421
  CDS Start-End: 78-431
agctctgggagaggagcccccgccctgggattcccaggtgttttcatttggtgatcagcactgaacacagaagagtcatgatggagtttgggctgagctgggttttccttgttgctatttttaaaggtgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgaga

SEQ ID NO: 142196 - DNA, 225 bp, Homo sapiens
  Payload ID: 8017
  Gene Symbol: IGHV3-64
  Gene Name: immunoglobulin heavy variable 3-64
  ENST ID: ENST00000618085
  CDS Start-End: 1-225
gcctctggattcaccttcagtagctatgctatgcactgggtccgccaggctccagggaagggactggaatatgtttcagctattagtagtaatgggggtagcacatattatgcagactctgtgaagggccgattcaccatctccagagacaatgcccagaattcactgtatctgcaaatgaacagcctgagagccgacgacatggctgtgtattactgtgtgaaa

SEQ ID NO: 142197 - DNA, 225 bp, Homo sapiens; identical to SEQ ID NO: 142196
  Payload ID: 8017
  Gene Symbol: IGHV3-64
  Gene Name: immunoglobulin heavy variable 3-64
  ENST ID: ENST00000611989
  CDS Start-End: 1-225

SEQ ID NO: 142198 - DNA, 433 bp, Homo sapiens
  Payload ID: 8017
  Gene Symbol: IGHV3-64
  Gene Name: immunoglobulin heavy variable 3-64
  ENST ID: ENST00000631710
  CDS Start-End: 78-433
agctctgggagaggagcccccgccctgggattcccaggtgttttcatttggtgatcagcactgaacacagaagagtcatgatggagtttgggctgagctgggttttccttgttgctatttttaaaggtgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagaga

SEQ ID NO: 142199 - DNA, 427 bp, Homo sapiens
  Payload ID: 8018
  Gene Symbol: IGHV3-66
  Gene Name: immunoglobulin heavy variable 3-66
  ENST ID: ENST00000390632
  CDS Start-End: 80-427
agctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgaga

SEQ ID NO: 142200 - DNA, 429 bp, Homo sapiens
  Payload ID: 8018
  Gene Symbol: IGHV3-66
  Gene Name: immunoglobulin heavy variable 3-66
  ENST ID: ENST00000632846
  CDS Start-End: 80-429
agctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagaga

SEQ ID NO: 142201 - DNA, 430 bp, Homo sapiens
  Payload ID: 8019
  Gene Symbol: IGHV3-7
  Gene Name: immunoglobulin heavy variable 3-7
  ENST ID: ENST00000390598
  CDS Start-End: 80-430
aggtctcagagaggagccttagccctggactccaaggcctttccacttggtgatcagcactgagcacagaggactcaccatggagttggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggccgtgtattactgtgcgaga

SEQ ID NO: 142202 - DNA, 432 bp, Homo sapiens
  Payload ID: 8019
  Gene Symbol: IGHV3-7
  Gene Name: immunoglobulin heavy variable 3-7
  ENST ID: ENST00000633988
  CDS Start-End: 80-432
aggtctcagagaggagccttagccctggactccaaggcctttccacttggtgatcagcactgagcacagaggactcaccatggagttggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggccgtgtattactgtgcgagaga

SEQ ID NO: 142203 - DNA, 437 bp, Homo sapiens
  Payload ID: 8020
  Gene Symbol: IGHV3-72
  Gene Name: immunoglobulin heavy variable 3-72
  ENST ID: ENST00000433072
  CDS Start-End: 81-437
agctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctaga

SEQ ID NO: 142204 - DNA, 303 bp, Homo sapiens
  Payload ID: 8020
  Gene Symbol: IGHV3-72
  Gene Name: immunoglobulin heavy variable 3-72
  ENST ID: ENST00000621503
  CDS Start-End: 1-303
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagac

SEQ ID NO: 142205 - DNA, 303 bp, Homo sapiens; identical to SEQ ID NO: 142204
  Payload ID: 8020
  Gene Symbol: IGHV3-72
  Gene Name: immunoglobulin heavy variable 3-72
  ENST ID: ENST00000614315
  CDS Start-End: 1-303

SEQ ID NO: 142206 - DNA, 439 bp, Homo sapiens
  Payload ID: 8020
  Gene Symbol: IGHV3-72
  Gene Name: immunoglobulin heavy variable 3-72
  ENST ID: ENST00000633602
  CDS Start-End: 81-439
agctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaga

SEQ ID NO: 142207 - DNA, 437 bp, Homo sapiens
  Payload ID: 8021
  Gene Symbol: IGHV3-73
  Gene Name: immunoglobulin heavy variable 3-73
  ENST ID: ENST00000390636
  CDS Start-End: 81-437
agctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactaga

SEQ ID NO: 142208 - DNA, 249 bp, Homo sapiens
  Payload ID: 8021
  Gene Symbol: IGHV3-73
  Gene Name: immunoglobulin heavy variable 3-73
  ENST ID: ENST00000622547
  CDS Start-End: 1-249
tccctgagactctcctgtgcagcctctggattcaccttcagtagctactggatgcactgggtccgccaagctccagggaaggggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtact

SEQ ID NO: 142209 - DNA, 439 bp, Homo sapiens
  Payload ID: 8021
  Gene Symbol: IGHV3-73
  Gene Name: immunoglobulin heavy variable 3-73
  ENST ID: ENST00000631708
  CDS Start-End: 81-439
agctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagaca

SEQ ID NO: 142210 - DNA, 587 bp, Homo sapiens
  Payload ID: 8022
  Gene Symbol: IGHV3-74
  Gene Name: immunoglobulin heavy variable 3-74
  ENST ID: ENST00000424969
  CDS Start-End: 237-587
aatttctcaaatcccattgttgtcacccatcttcctcaggacactttcatctgccctgggtcctgctctttcttcaggtgtctcaccccagagcttgatatatagtaggagacatgcaaatagggccctcactctgctgaagaaaaccagccctgcagctctgggagaggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaga

SEQ ID NO: 142211 - DNA, 589 bp, Homo sapiens
  Payload ID: 8022
  Gene Symbol: IGHV3-74
  Gene Name: immunoglobulin heavy variable 3-74
  ENST ID: ENST00000633987
  CDS Start-End: 237-589
aatttctcaaatcccattgttgtcacccatcttcctcaggacactttcatctgccctgggtcctgctctttcttcaggtgtctcaccccagagcttgatatatagtaggagacatgcaaatagggccctcactctgctgaagaaaaccagccctgcagctctgggagaggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagaga

SEQ ID NO: 142212 - DNA, 353 bp, Homo sapiens
  Payload ID: 8023
  Gene Symbol: IGHV4OR15-8
  Gene Name: immunoglobulin heavy variable 4/OR15-8 (non-functional)
  ENST ID: ENST00000557788
  CDS Start-End: 1-353
atgaaacacctgtggttctttctcctcctggtggcagctcccagatgggtcctgtcccaggtgcagctgcaggagtcgggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccgtccctcaagagtcgagtcaccatatcagtagacaagtccaagaaccagttctccctgaagctgagctctgtgaccgccgcggacagggccgtgtattactgtgcgagaga

SEQ ID NO: 142213 - DNA, 425 bp, Homo sapiens
  Payload ID: 8024
  Gene Symbol: IGHV4-28
  Gene Name: immunoglobulin heavy variable 4-28
  ENST ID: ENST00000390612
  CDS Start-End: 73-425
atttccttaaattcagggtcctgctcacatgggaaatactttctgagagtcctggacctcctgtgcaagaacatgaaacacctgtggttcttcctcctgctggtggcagctcccagatgggtcctgtcccaggtacagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 142214 - DNA, 425 bp, Homo sapiens; identical to SEQ ID NO: 142213
  Payload ID: 8024
  Gene Symbol: IGHV4-28
  Gene Name: immunoglobulin heavy variable 4-28
  ENST ID: ENST00000632719
  CDS Start-End: 73-425

SEQ ID NO: 142215 - DNA, 428 bp, Homo sapiens
  Payload ID: 8025
  Gene Symbol: IGHV4-31
  Gene Name: immunoglobulin heavy variable 4-31
  ENST ID: ENST00000438142
  CDS Start-End: 73-428
atttccttaaattcagggtccagctcacatgggaaatactttctgagagtcctggacctcctgtgcaagaacatgaaacacctgtggttcttcctcctgctggtggcagctcccagatgggtcctgtcccagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgccagaga

SEQ ID NO: 142216 - DNA, 391 bp, Homo sapiens
  Payload ID: 8025
  Gene Symbol: IGHV4-31
  Gene Name: immunoglobulin heavy variable 4-31
  ENST ID: ENST00000632151
  CDS Start-End: 36-391
actttctgagagtcctggacctcctgcacaagaacatgaaacacctgtggttcttcctcctgctggtggcagctcccagatgggtcctgtcccagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgccagaga

SEQ ID NO: 142217 - DNA, 400 bp, Homo sapiens
  Payload ID: 8026
  Gene Symbol: IGHV4-34
  Gene Name: immunoglobulin heavy variable 4-34
  ENST ID: ENST00000390616
  CDS Start-End: 32-400
cagctcacatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgaga

SEQ ID NO: 142218 - DNA, 402 bp, Homo sapiens
  Payload ID: 8026
  Gene Symbol: IGHV4-34
  Gene Name: immunoglobulin heavy variable 4-34
  ENST ID: ENST00000612474
  CDS Start-End: 32-402
cagctcacatgggaagtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 142219 - DNA, 425 bp, Homo sapiens
  Payload ID: 8027
  Gene Symbol: IGHV4-39
  Gene Name: immunoglobulin heavy variable 4-39
  ENST ID: ENST00000390619
  CDS Start-End: 51-425
atttccttaaattcaggtccaactcataagggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgaga

SEQ ID NO: 142220 - DNA, 427 bp, Homo sapiens
  Payload ID: 8027
  Gene Symbol: IGHV4-39
  Gene Name: immunoglobulin heavy variable 4-39
  ENST ID: ENST00000633618
  CDS Start-End: 51-427
atttccttaaattcaggtccaactcataagggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagaca

SEQ ID NO: 142221 - DNA, 417 bp, Homo sapiens
  Payload ID: 8028
  Gene Symbol: IGHV4-4
  Gene Name: immunoglobulin heavy variable 4-4
  ENST ID: ENST00000455737
  CDS Start-End: 65-417
aaattcagggtccagctcacatgggaaatactttctgagagtcatggacctcctgcacaagaacatgaaacacctgtggttcttcctcctcctggtggcagctcccagatgggtcctgtctcaggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagaga

SEQ ID NO: 142222 - DNA, 417 bp, Homo sapiens; identical to SEQ ID NO: 142221
  Payload ID: 8028
  Gene Symbol: IGHV4-4
  Gene Name: immunoglobulin heavy variable 4-4
  ENST ID: ENST00000631379
  CDS Start-End: 65-417

SEQ ID NO: 142223 - DNA, 495 bp, Homo sapiens
  Payload ID: 8029
  Gene Symbol: IGHV4-59
  Gene Name: immunoglobulin heavy variable 4-59
  ENST ID: ENST00000390629
  CDS Start-End: 146-495
ttttcacctctccatacaaaggcaccacccacatgcaaatcctcacttaagcacccacaggaaaccaccacacatttccttaaattcaggttccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 142224 - DNA, 495 bp, Homo sapiens; identical to SEQ ID NO: 142223
  Payload ID: 8029
  Gene Symbol: IGHV4-59
  Gene Name: immunoglobulin heavy variable 4-59
  ENST ID: ENST00000619078
  CDS Start-End: 146-495

SEQ ID NO: 142225 - DNA, 457 bp, Homo sapiens
  Payload ID: 8030
  Gene Symbol: IGHV4-61
  Gene Name: immunoglobulin heavy variable 4-61
  ENST ID: ENST00000390630
  CDS Start-End: 102-457
acttaagcacccacaggaaaccaccacacatttccttaaattcaggttccagctcacatgggaaatactttctgagagtcctggacctcctgtgcaagaacatgaaacacctgtggttcttcctcctcctggtggcagctcccagatgggtcctgtcccaggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 142226 - DNA, 457 bp, Homo sapiens; identical to SEQ ID NO: 142225
  Payload ID: 8030
  Gene Symbol: IGHV4-61
  Gene Name: immunoglobulin heavy variable 4-61
  ENST ID: ENST00000632960
  CDS Start-End: 102-457

SEQ ID NO: 142227 - DNA, 410 bp, Homo sapiens
  Payload ID: 8031
  Gene Symbol: IGHV5-51
  Gene Name: immunoglobulin heavy variable 5-51
  ENST ID: ENST00000390626
  CDS Start-End: 60-410
tgagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaga

SEQ ID NO: 142228 - DNA, 412 bp, Homo sapiens
  Payload ID: 8031
  Gene Symbol: IGHV5-51
  Gene Name: immunoglobulin heavy variable 5-51
  ENST ID: ENST00000620764
  CDS Start-End: 60-412
tgagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 142229 - DNA, 415 bp, Homo sapiens
  Payload ID: 8032
  Gene Symbol: IGHV6-1
  Gene Name: immunoglobulin heavy variable 6-1
  ENST ID: ENST00000390593
  CDS Start-End: 53-415
gcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaaga

SEQ ID NO: 142230 - DNA, 417 bp, Homo sapiens
  Payload ID: 8032
  Gene Symbol: IGHV6-1
  Gene Name: immunoglobulin heavy variable 6-1
  ENST ID: ENST00000633299
  CDS Start-End: 53-417
gcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 142231 - DNA, 405 bp, Homo sapiens
  Payload ID: 8033
  Gene Symbol: IGHV7-81
  Gene Name: immunoglobulin heavy variable 7-81 (non-functional)
  ENST ID: ENST00000390639
  CDS Start-End: 55-405
acccaacaacaacatccctccttgggagaatcccctagagcacagctcctcaccatggactggacctggagcatcctcttcttggtggcagcagcaacaggtacctactcccaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgcgaga

SEQ ID NO: 142232 - DNA, 523 bp, Homo sapiens
  Payload ID: 8034
  Gene Symbol: IGKC
  Gene Name: immunoglobulin kappa constant
  ENST ID: ENST00000390237
  CDS Start-End: 1-323
gaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacctgt

SEQ ID NO: 142233 - DNA, 912 bp, Homo sapiens
  Payload ID: 8034
  Gene Symbol: IGKC
  Gene Name: immunoglobulin kappa constant
  ENST ID: ENST00000614656
  CDS Start-End: 1-720
gtgaggctccctgctcagctcctggggctgctaatgctctgggtccctggatccagtggggatattgtgatgacccagcatctgctctccctgcccatccctctgggagagccggcctccatctcctgcaggtctagtcagagcctcctgcatagtgatggaaacacctatttggattggtacctgcagaagccaggccagtctccacagcttcttatctacacaatttctaacaaattctatggagtcccaaacaagttcagtggcagcaggtcagggacaggtttcacacttaaattcagcaaagtggaggctgaggatgttggggtttattgctgtgaacagggtctgcaagctccatccatttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatcttt

SEQ ID NO: 142234 - DNA, 910 bp, Homo sapiens
  Payload ID: 8034
  Gene Symbol: IGKC
  Gene Name: immunoglobulin kappa constant
  ENST ID: ENST00000430694
  CDS Start-End: 354-713
tggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattacctgtggctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacc

SEQ ID NO: 142235 - DNA, 910 bp, Homo sapiens; identical to SEQ ID NO: 142234
  Payload ID: 8034
  Gene Symbol: IGKC
  Gene Name: immunoglobulin kappa constant
  ENST ID: ENST00000611170
  CDS Start-End: 354-713

SEQ ID NO: 142236 - DNA, 523 bp, Homo sapiens; identical to SEQ ID NO: 142232
  Payload ID: 8034
  Gene Symbol: IGKC
  Gene Name: immunoglobulin kappa constant
  ENST ID: ENST00000614252
  CDS Start-End: 1-323

SEQ ID NO: 142237 - DNA, 912 bp, Homo sapiens; identical to SEQ ID NO: 142233
  Payload ID: 8034
  Gene Symbol: IGKC
  Gene Name: immunoglobulin kappa constant
  ENST ID: ENST00000610638
  CDS Start-End: 1-720

SEQ ID NO: 142238 - DNA, 38 bp, Homo sapiens
  Payload ID: 8035
  Gene Symbol: IGKJ1
  Gene Name: immunoglobulin kappa joining 1
  ENST ID: ENST00000390242
  CDS Start-End: 1-38
gtggacgttcggccaagggaccaaggtggaaatcaaac

SEQ ID NO: 142239 - DNA, 39 bp, Homo sapiens
  Payload ID: 8036
  Gene Symbol: IGKJ2
  Gene Name: immunoglobulin kappa joining 2
  ENST ID: ENST00000390241
  CDS Start-End: 1-39
tgtgcagttttggccaggggaccaagctggagatcaaac

SEQ ID NO: 142240 - DNA, 38 bp, Homo sapiens
  Payload ID: 8037
  Gene Symbol: IGKJ3
  Gene Name: immunoglobulin kappa joining 3
  ENST ID: ENST00000390240
  CDS Start-End: 1-38
attcactttcggccctgggaccaaagtggatatcaaac

SEQ ID NO: 142241 - DNA, 37 bp, Homo sapiens
  Payload ID: 8038
  Gene Symbol: IGKJ4
  Gene Name: immunoglobulin kappa joining 4
  ENST ID: ENST00000390239
  CDS Start-End: 1-37
ctcactttcggcggagggaccaaggtggagatcaaac

SEQ ID NO: 142242 - DNA, 38 bp, Homo sapiens
  Payload ID: 8039
  Gene Symbol: IGKJ5
  Gene Name: immunoglobulin kappa joining 5
  ENST ID: ENST00000390238
  CDS Start-End: 1-38
gatcaccttcggccaagggacacgactggagattaaac

SEQ ID NO: 142243 - DNA, 353 bp, Homo sapiens
  Payload ID: 8040
  Gene Symbol: IGKV1OR2-108
  Gene Name: immunoglobulin kappa variable 1/OR2-108 (non-functional)
  ENST ID: ENST00000453673
  CDS Start-End: 1-353
atggaaatgagggtccccgctcagctcctggggctcctgctgctctggctccgaggtgccagatgtgacatccaggtgacccagtctccatcttccctgtctgcgtctgtaggagacagagtcaccatcacctgccgggcaagtcagggcattagcaatgggttatcctggtatcagcagaaaccagggcaagcccctacgctcctgatctatgctgcatccagtttgcagtcgggggtcccatctcggttcagtggcagtggatctgggacagatttcactctcaccatcagcagcctgcagcctgaagatgttgcaacttattactgtctacaggattatactaccccatt

SEQ ID NO: 142244 - DNA, 398 bp, Homo sapiens
  Payload ID: 8041
  Gene Symbol: IGKV1-12
  Gene Name: immunoglobulin kappa variable 1-12
  ENST ID: ENST00000480492
  CDS Start-End: 48-398
aggctgatcacaccctgtgcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccct

SEQ ID NO: 142245 - DNA, 555 bp, Homo sapiens
  Payload ID: 8041
  Gene Symbol: IGKV1-12
  Gene Name: immunoglobulin kappa variable 1-12
  ENST ID: ENST00000377423
  CDS Start-End: 1-555
atggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggtggagagctctcactgtacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtc

SEQ ID NO: 142246 - DNA, 398 bp, Homo sapiens; identical to SEQ ID NO: 142244
  Payload ID: 8041
  Gene Symbol: IGKV1-12
  Gene Name: immunoglobulin kappa variable 1-12
  ENST ID: ENST00000632502
  CDS Start-End: 48-398

SEQ ID NO: 142247 - DNA, 555 bp, Homo sapiens; identical to SEQ ID NO: 142245
  Payload ID: 8041
  Gene Symbol: IGKV1-12
  Gene Name: immunoglobulin kappa variable 1-12
  ENST ID: ENST00000634628
  CDS Start-End: 1-555

SEQ ID NO: 142248 - DNA, 378 bp, Homo sapiens
  Payload ID: 8042
  Gene Symbol: IGKV1-16
  Gene Name: immunoglobulin kappa variable 1-16
  ENST ID: ENST00000479981
  CDS Start-End: 28-378
aggaatcagacccagtcaggacacagcatggacatgagagtcctcgctcagctcctggggctcctgctgctctgtttcccaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttaccct

SEQ ID NO: 142249 - DNA, 378 bp, Homo sapiens; identical to SEQ ID NO: 142248
  Payload ID: 8042
  Gene Symbol: IGKV1-16
  Gene Name: immunoglobulin kappa variable 1-16
  ENST ID: ENST00000632011
  CDS Start-End: 28-378

SEQ ID NO: 142250 - DNA, 378 bp, Homo sapiens
  Payload ID: 8043
  Gene Symbol: IGKV1-17
  Gene Name: immunoglobulin kappa variable 1-17
  ENST ID: ENST00000490686
  CDS Start-End: 28-378
aggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccct

SEQ ID NO: 142251 - DNA, 378 bp, Homo sapiens; identical to SEQ ID NO: 142250
  Payload ID: 8043
  Gene Symbol: IGKV1-17
  Gene Name: immunoglobulin kappa variable 1-17
  ENST ID: ENST00000632229
  CDS Start-End: 28-378

SEQ ID NO: 142252 - DNA, 382 bp, Homo sapiens
  Payload ID: 8044
  Gene Symbol: IGKV1-27
  Gene Name: immunoglobulin kappa variable 1-27
  ENST ID: ENST00000498435
  CDS Start-End: 32-382
gtgcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccct

SEQ ID NO: 142253 - DNA, 382 bp, Homo sapiens; identical to SEQ ID NO: 142252
  Payload ID: 8044
  Gene Symbol: IGKV1-27
  Gene Name: immunoglobulin kappa variable 1-27
  ENST ID: ENST00000631531
  CDS Start-End: 32-382

SEQ ID NO: 142254 - DNA, 382 bp, Homo sapiens
  Payload ID: 8045
  Gene Symbol: IGKV1-33
  Gene Name: immunoglobulin kappa variable 1-33
  ENST ID: ENST00000473726
  CDS Start-End: 32-382
gtgcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccct

SEQ ID NO: 142255 - DNA, 324 bp, Homo sapiens
  Payload ID: 8045
  Gene Symbol: IGKV1-33
  Gene Name: immunoglobulin kappa variable 1-33
  ENST ID: ENST00000558152
  CDS Start-End: 1-324
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcccacagttggcaaaggacatgaacagacacttaaaaga

SEQ ID NO: 142256 - DNA, 382 bp, Homo sapiens; identical to SEQ ID NO: 142254
  Payload ID: 8045
  Gene Symbol: IGKV1-33
  Gene Name: immunoglobulin kappa variable 1-33
  ENST ID: ENST00000632835
  CDS Start-End: 32-382

SEQ ID NO: 142257 - DNA, 324 bp, Homo sapiens; identical to SEQ ID NO: 142255
  Payload ID: 8045
  Gene Symbol: IGKV1-33
  Gene Name: immunoglobulin kappa variable 1-33
  ENST ID: ENST00000634204
  CDS Start-End: 1-324

SEQ ID NO: 142258 - DNA, 398 bp, Homo sapiens
  Payload ID: 8046
  Gene Symbol: IGKV1-37
  Gene Name: immunoglobulin kappa variable 1-37 (non-functional)
  ENST ID: ENST00000465170
  CDS Start-End: 48-398
aggctggtcacaccccgtgcagcagtcagtcccagtcaggacacagcatggacatgagggtccccgctcagctcctggggctcctactgctctgggtcccaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccct

SEQ ID NO: 142259 - DNA, 398 bp, Homo sapiens; identical to SEQ ID NO: 142258
  Payload ID: 8046
  Gene Symbol: IGKV1-37
  Gene Name: immunoglobulin kappa variable 1-37 (non-functional)
  ENST ID: ENST00000632103
  CDS Start-End: 48-398

SEQ ID NO: 142260 - DNA, 398 bp, Homo sapiens
  Payload ID: 8047
  Gene Symbol: IGKV1-39
  Gene Name: immunoglobulin kappa variable 1-39 (gene/pseudogene)
  ENST ID: ENST00000498574
  CDS Start-End: 48-398
gggctggtcgcaccctgtgcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccct

SEQ ID NO: 142261 - DNA, 398 bp, Homo sapiens; identical to SEQ ID NO: 142260
  Payload ID: 8047
  Gene Symbol: IGKV1-39
  Gene Name: immunoglobulin kappa variable 1-39 (gene/pseudogene)
  ENST ID: ENST00000631411
  CDS Start-End: 48-398

SEQ ID NO: 142262 - DNA, 532 bp, Homo sapiens
  Payload ID: 8048
  Gene Symbol: IGKV1-5
  Gene Name: immunoglobulin kappa variable 1-5
  Uniprot ID: P01602
  ENST ID: ENST00000496168
  CDS Start-End: 182-532
gggacacctggggacactgagctggtgctgagttactgagatgagccagctctgcagctgtgcccagcctgccccatcccctgctcatttgcatgttcccagagcacaacctcctgccctgaagccttattaataggctggtcacactttgtgcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattct

SEQ ID NO: 142263 - DNA, 532 bp, Homo sapiens; identical to SEQ ID NO: 142262
  Payload ID: 8048
  Gene Symbol: IGKV1-5
  Gene Name: immunoglobulin kappa variable 1-5
  Uniprot ID: P01602
  ENST ID: ENST00000632205
  CDS Start-End: 182-532

SEQ ID NO: 142264 - DNA, 380 bp, Homo sapiens
  Payload ID: 8049
  Gene Symbol: IGKV1-6
  Gene Name: immunoglobulin kappa variable 1-6
  ENST ID: ENST00000464162
  CDS Start-End: 30-380
gcaggagtcagacccactcaggacacagcatggacatgagggtccccgctcagctcctggggctcctgctgctctggctcccaggtgccagatgtgccatccagatgacccagtctccatcctccctgtctgcatctgttggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccct

SEQ ID NO: 142265 - DNA, 380 bp, Homo sapiens; identical to SEQ ID NO: 142264
  Payload ID: 8049
  Gene Symbol: IGKV1-6
  Gene Name: immunoglobulin kappa variable 1-6
  ENST ID: ENST00000632891
  CDS Start-End: 30-380

SEQ ID NO: 142266 - DNA, 398 bp, Homo sapiens
  Payload ID: 8050
  Gene Symbol: IGKV1-8
  Gene Name: immunoglobulin kappa variable 1-8
  ENST ID: ENST00000495489
  CDS Start-End: 54-398
aggctggacacacttcatgcaggagtcagaccctgtcaggacacagcatagacatgagggtccccgctcagctcctggggctcctgctgctctggctcccaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccct

SEQ ID NO: 142267 - DNA, 398 bp, Homo sapiens; identical to SEQ ID NO: 142266
  Payload ID: 8050
  Gene Symbol: IGKV1-8
  Gene Name: immunoglobulin kappa variable 1-8
  ENST ID: ENST00000631614
  CDS Start-End: 54-398

SEQ ID NO: 142268 - DNA, 549 bp, Homo sapiens
  Payload ID: 8050
  Gene Symbol: IGKV1-8
  Gene Name: immunoglobulin kappa variable 1-8
  ENST ID: ENST00000635151
  CDS Start-End: 1-549
atgagggtccccgctcagctcctggggctcctgctgctctggctcccaggtgccagatgtgacatccagttgacccagtctccatccttcctgtctgcatctgtaggagacagagtcaccatcacttgccgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctcccacatttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtc

SEQ ID NO: 142269 - DNA, 549 bp, Homo sapiens; identical to SEQ ID NO: 142268
  Payload ID: 8050
  Gene Symbol: IGKV1-8
  Gene Name: immunoglobulin kappa variable 1-8
  ENST ID: ENST00000634828
  CDS Start-End: 1-549

SEQ ID NO: 142270 - DNA, 409 bp, Homo sapiens
  Payload ID: 8051
  Gene Symbol: IGKV1-9
  Gene Name: immunoglobulin kappa variable 1-9
  ENST ID: ENST00000493819
  CDS Start-End: 59-409
agacttcttaataggctggtcacacctgtgcaggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccct

SEQ ID NO: 142271 - DNA, 409 bp, Homo sapiens; identical to SEQ ID NO: 142270
  Payload ID: 8051
  Gene Symbol: IGKV1-9
  Gene Name: immunoglobulin kappa variable 1-9
  ENST ID: ENST00000633273
  CDS Start-End: 59-409

SEQ ID NO: 142272 - DNA, 371 bp, Homo sapiens
  Payload ID: 8052
  Gene Symbol: IGKV1D-12
  Gene Name: immunoglobulin kappa variable 1D-12
  ENST ID: ENST00000377032
  CDS Start-End: 21-371
agacccactcaggacacagcatggacatgatggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccct

SEQ ID NO: 142273 - DNA, 376 bp, Homo sapiens
  Payload ID: 8053
  Gene Symbol: IGKV1D-13
  Gene Name: immunoglobulin kappa variable 1D-13
  ENST ID: ENST00000611391
  CDS Start-End: 26-376
gagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccct

SEQ ID NO: 142274 - DNA, 378 bp, Homo sapiens
  Payload ID: 8054
  Gene Symbol: IGKV1D-16
  Gene Name: immunoglobulin kappa variable 1D-16
  Uniprot ID: P01601
  ENST ID: ENST00000492446
  CDS Start-End: 28-378
aggaatcagacccagtcaggacacagcatggacatgagggtcctcgctcagctcctggggctcctgctgctctgtttcccaggtgccagatgtgacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccct

SEQ ID NO: 142275 - DNA, 532 bp, Homo sapiens
  Payload ID: 8055
  Gene Symbol: IGKV1D-17
  Gene Name: immunoglobulin kappa variable 1D-17
  ENST ID: ENST00000483379
  CDS Start-End: 182-532
gggacacctggggacactgagctgctgctgagttactgagatgagccagccctgcagctgcgcccagcctgccccatcccctgctcatttgcatgttcccagagcatagcctcctgccctgaagccttattaataggctggacacacttcatggaggaatcagtcccactcaggacacagcatggacatgagggtccctgctcagctcctggggctcctgctgctctggttcccaggtgccagatgtaacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaattcactctcacaatcagcagcctgcagcctgaagattttgcaacttattactgtctacagcataatagttaccct

SEQ ID NO: 142276 - DNA, 440 bp, Homo sapiens
  Payload ID: 8056
  Gene Symbol: IGKV1D-33
  Gene Name: immunoglobulin kappa variable 1D-33
  ENST ID: ENST00000390265
  CDS Start-End: 90-440
atgttcgcagagcacagccccctgccctgaagacttattaataggctggtcgcaccctgtgcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccct

SEQ ID NO: 142277 - DNA, 324 bp, Homo sapiens; identical to SEQ ID NO: 142255
  Payload ID: 8056
  Gene Symbol: IGKV1D-33
  Gene Name: immunoglobulin kappa variable 1D-33
  ENST ID: ENST00000611734
  CDS Start-End: 1-324

SEQ ID NO: 142278 - DNA, 353 bp, Homo sapiens
  Payload ID: 8057
  Gene Symbol: IGKV1D-37
  Gene Name: immunoglobulin kappa variable 1D-37 (non-functional)
  ENST ID: ENST00000509129
  CDS Start-End: 1-353
atggacatgagggtccccgctcagctcctggggctcctactgctctgggtcccaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccctcc

SEQ ID NO: 142279 - DNA, 376 bp, Homo sapiens
  Payload ID: 8058
  Gene Symbol: IGKV1D-39
  Gene Name: immunoglobulin kappa variable 1D-39
  ENST ID: ENST00000448155
  CDS Start-End: 24-376
gtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcc

SEQ ID NO: 142280 - DNA, 373 bp, Homo sapiens
  Payload ID: 8059
  Gene Symbol: IGKV1D-42
  Gene Name: immunoglobulin kappa variable 1D-42 (non-functional)
  ENST ID: ENST00000390278
  CDS Start-End: 21-373
agtcccagtcaggacacagcatggacatgagggtccccgctcagctcctggggctcctgctgctctggctcccaggtgtcagatttgacatccagatgacccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctcc

SEQ ID NO: 142281 - DNA, 532 bp, Homo sapiens
  Payload ID: 8060
  Gene Symbol: IGKV1D-43
  Gene Name: immunoglobulin kappa variable 1D-43
  ENST ID: ENST00000468879
  CDS Start-End: 182-532
gggacacctggggacactgagctggtgctgagttactgagatgaaccagccctgcagctgtgcccagcctgccttgccccctgctaatttgcatgttcccagagcacatcctcctaccctgaagacttattaatgcgctggtcacacttcatgcaggagtcagacccagtcaggacacagcatggacatgagggtgcccgctcagcgcctggggctcctgctgctctggttcccaggtgccagatgtgccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccct

SEQ ID NO: 142282 - DNA, 534 bp, Homo sapiens
  Payload ID: 8061
  Gene Symbol: IGKV1D-8
  Gene Name: immunoglobulin kappa variable 1D-8
  ENST ID: ENST00000471857
  CDS Start-End: 182-534
gggacacctggggacactgagctggtgctgagttactgagatgagccagctctgcagctgtgcccagtcagccccatcccctgctcatttgcatgttcccagagcacaacctcctgcactgaagccttattaataggctggccacacttcatgcaggagtcagacccagtcaggacacagcatggacatgagggtccccgctcagctcctggggctcctgctgctctggctcccaggtgccagatgtgccatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagctgcctgcagtctgaagattttgcaacttattactgtcaacagtattatagtttccctcc

SEQ ID NO: 142283 - DNA, 534 bp, Homo sapiens
  Payload ID: 8061
  Gene Symbol: IGKV1D-8
  Gene Name: immunoglobulin kappa variable 1D-8
  ENST ID: ENST00000628219
  CDS Start-End: 182-534
gggacacctggggacactgagctggtgctgagttactgagatgagccagctctgcagctgtgcccagtcagccccatcccctgctcatttgcatgttcccagagcacaacctcctgcactgaagccttattaataggctggccacacttcatgcaggagtcagacccagtcaggacacagcatggacatgagggtccccgctcagctcctggggctcctgctgctctggctcccaggtgccagatgtgtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttccctcc

SEQ ID NO: 142284 - DNA, 390 bp, Homo sapiens
  Payload ID: 8062
  Gene Symbol: IGKV2-24
  Gene Name: immunoglobulin kappa variable 2-24
  ENST ID: ENST00000484817
  CDS Start-End: 31-390
aattaggactcctcaggtcaccttctcacaatgaggctccttgctcagcttctggggctgctaatgctctgggtccctggatccagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcct

SEQ ID NO: 142285 - DNA, 390 bp, Homo sapiens; identical to SEQ ID NO: 142284
  Payload ID: 8062
  Gene Symbol: IGKV2-24
  Gene Name: immunoglobulin kappa variable 2-24
  ENST ID: ENST00000633851
  CDS Start-End: 31-390

SEQ ID NO: 142286 - DNA, 390 bp, Homo sapiens
  Payload ID: 8063
  Gene Symbol: IGKV2-28
  Gene Name: immunoglobulin kappa variable 2-28
  ENST ID: ENST00000482769
  CDS Start-End: 31-390
gatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcct

SEQ ID NO: 142287 - DNA, 390 bp, Homo sapiens; identical to SEQ ID NO: 142286
  Payload ID: 8063
  Gene Symbol: IGKV2-28
  Gene Name: immunoglobulin kappa variable 2-28
  ENST ID: ENST00000633682
  CDS Start-End: 31-390

SEQ ID NO: 142288 - DNA, 390 bp, Homo sapiens
  Payload ID: 8064
  Gene Symbol: IGKV2-30
  Gene Name: immunoglobulin kappa variable 2-30
  ENST ID: ENST00000468494
  CDS Start-End: 31-390
gatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcct

SEQ ID NO: 142289 - DNA, 390 bp, Homo sapiens; identical to SEQ ID NO: 142288
  Payload ID: 8064
  Gene Symbol: IGKV2-30
  Gene Name: immunoglobulin kappa variable 2-30
  ENST ID: ENST00000632910
  CDS Start-End: 31-390

SEQ ID NO: 142290 - DNA, 314 bp, Homo sapiens
  Payload ID: 8065
  Gene Symbol: IGKV2-40
  Gene Name: immunoglobulin kappa variable 2-40
  ENST ID: ENST00000620613
  CDS Start-End: 1-314
gatccagtgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttcct

SEQ ID NO: 142291 - DNA, 312 bp, Homo sapiens
  Payload ID: 8065
  Gene Symbol: IGKV2-40
  Gene Name: immunoglobulin kappa variable 2-40
  ENST ID: ENST00000621595
  CDS Start-End: 1-312
gaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttccaca

SEQ ID NO: 142292 - DNA, 314 bp, Homo sapiens; identical to SEQ ID NO: 142290
  Payload ID: 8065
  Gene Symbol: IGKV2-40
  Gene Name: immunoglobulin kappa variable 2-40
  ENST ID: ENST00000632384
  CDS Start-End: 1-314

SEQ ID NO: 142293 - DNA, 312 bp, Homo sapiens; identical to SEQ ID NO: 142291
  Payload ID: 8065
  Gene Symbol: IGKV2-40
  Gene Name: immunoglobulin kappa variable 2-40
  ENST ID: ENST00000632811
  CDS Start-End: 1-312

SEQ ID NO: 142294 - DNA, 390 bp, Homo sapiens
  Payload ID: 8066
  Gene Symbol: IGKV2D-24
  Gene Name: immunoglobulin kappa variable 2D-24 (non-functional)
  ENST ID: ENST00000462693
  CDS Start-End: 31-390
aattaggactcctcaggtcaccttctcacaatgaggctccttgctcagcttctggggctgctaatgctctgggtccctggatccagtggggatattgtgatgacccagactccactctcctcgcctgtcacccttggacagccggcctccatctccttcaggtctagtcaaagcctcgtacacagtgatggaaacacctacttgagttggcttcagcagaggccaggccagcctccaagactcctaatttataaggtttctaaccggttctctggggtcccagacagattcagtggcagtggggcagggacagatttcacactgaaaatcagcagggtggaagctgaggatgtcggggtttattactgcacgcaagctacacaatttcct

SEQ ID NO: 142295 - DNA, 390 bp, Homo sapiens
  Payload ID: 8067
  Gene Symbol: IGKV2D-26
  Gene Name: immunoglobulin kappa variable 2D-26
  ENST ID: ENST00000390268
  CDS Start-End: 31-390
gatcaggactcctcagttcaccttctcactatgaggctccctgctcagctcttggggctgctaatgctctgggtccctggatccagtgcagagattgtgatgacccagactccactctccttgtctatcacccctggagagcaggcctccatgtcctgcaggtctagtcagagcctcctgcatagtgatggatacacctatttgtattggtttctgcagaaagccaggccagtctccacgctcctgatctatgaagtttccaaccggttctctggagtgccagataggttcagtggcagcgggtcagggacagatttcacactgaaaatcagccgggtggaggctgaggattttggagtttattactgcatgcaagatgcacaagatcct

SEQ ID NO: 142296 - DNA, 396 bp, Homo sapiens
  Payload ID: 8068
  Gene Symbol: IGKV2D-28
  Gene Name: immunoglobulin kappa variable 2D-28
  ENST ID: ENST00000453166
  CDS Start-End: 37-396
ttgactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcct

SEQ ID NO: 142297 - DNA, 306 bp, Homo sapiens
  Payload ID: 8068
  Gene Symbol: IGKV2D-28
  Gene Name: immunoglobulin kappa variable 2D-28
  ENST ID: ENST00000558026
  CDS Start-End: 1-306
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcccaca

SEQ ID NO: 142298 - DNA, 390 bp, Homo sapiens
  Payload ID: 8069
  Gene Symbol: IGKV2D-29
  Gene Name: immunoglobulin kappa variable 2D-29
  ENST ID: ENST00000491977
  CDS Start-End: 31-390
gatcaggacttctcagttcatcttctcaccatgaggctccctgctcagctcctggggctgctaatgctctggatacctggatccagtgcagatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcct

SEQ ID NO: 142299 - DNA, 310 bp, Homo sapiens
  Payload ID: 8069
  Gene Symbol: IGKV2D-29
  Gene Name: immunoglobulin kappa variable 2D-29
  ENST ID: ENST00000612356
  CDS Start-End: 1-306
gatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctcccacagtgg

SEQ ID NO: 142300 - DNA, 395 bp, Homo sapiens
  Payload ID: 8070
  Gene Symbol: IGKV2D-30
  Gene Name: immunoglobulin kappa variable 2D-30
  ENST ID: ENST00000474213
  CDS Start-End: 36-395
tgactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcct

SEQ ID NO: 142301 - DNA, 332 bp, Homo sapiens
  Payload ID: 8071
  Gene Symbol: IGKV2D-40
  Gene Name: immunoglobulin kappa variable 2D-40
  ENST ID: ENST00000429992
  CDS Start-End: 1-332
atgctctgggtccctggatccagtgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttc

SEQ ID NO: 142302 - DNA, 312 bp, Homo sapiens; identical to SEQ ID NO: 142291
  Payload ID: 8071
  Gene Symbol: IGKV2D-40
  Gene Name: immunoglobulin kappa variable 2D-40
  ENST ID: ENST00000560045
  CDS Start-End: 1-312

SEQ ID NO: 142303 - DNA, 350 bp, Homo sapiens
  Payload ID: 8072
  Gene Symbol: IGKV3OR2-268
  Gene Name: immunoglobulin kappa variable 3/OR2-268 (non-functional)
  ENST ID: ENST00000421835
  CDS Start-End: 1-350
atggaagccccagcacagcttctcttcctcctgctactctggctcccagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcc

SEQ ID NO: 142304 - DNA, 392 bp, Homo sapiens
  Payload ID: 8073
  Gene Symbol: IGKV3-11
  Gene Name: immunoglobulin kappa variable 3-11
  Uniprot ID: P04433
  ENST ID: ENST00000483158
  CDS Start-End: 48-392
gtcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcct

SEQ ID NO: 142305 - DNA, 392 bp, Homo sapiens; identical to SEQ ID NO: 142304
  Payload ID: 8073
  Gene Symbol: IGKV3-11
  Gene Name: immunoglobulin kappa variable 3-11
  Uniprot ID: P04433
  ENST ID: ENST00000632088
  CDS Start-End: 48-392

SEQ ID NO: 142306 - DNA, 442 bp, Homo sapiens
  Payload ID: 8074
  Gene Symbol: IGKV3-15
  Gene Name: immunoglobulin kappa variable 3-15
  ENST ID: ENST00000390252
  CDS Start-End: 98-442
gcatgtccctcccagctgccctaccttccagagcccatatcaatgcctgggtcagagctctggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcct

SEQ ID NO: 142307 - DNA, 442 bp, Homo sapiens; identical to SEQ ID NO: 142306
  Payload ID: 8074
  Gene Symbol: IGKV3-15
  Gene Name: immunoglobulin kappa variable 3-15
  ENST ID: ENST00000632887
  CDS Start-End: 98-442

SEQ ID NO: 142308 - DNA, 400 bp, Homo sapiens
  Payload ID: 8075
  Gene Symbol: IGKV3-20
  Gene Name: immunoglobulin kappa variable 3-20
  ENST ID: ENST00000492167
  CDS Start-End: 53-400
cctgggtcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacct

SEQ ID NO: 142309 - DNA, 400 bp, Homo sapiens; identical to SEQ ID NO: 142308
  Payload ID: 8075
  Gene Symbol: IGKV3-20
  Gene Name: immunoglobulin kappa variable 3-20
  ENST ID: ENST00000632822
  CDS Start-End: 53-400

SEQ ID NO: 142310 - DNA, 445 bp, Homo sapiens
  Payload ID: 8076
  Gene Symbol: IGKV3-7
  Gene Name: immunoglobulin kappa variable 3-7 (non-functional)
  ENST ID: ENST00000390247
  CDS Start-End: 98-445
gcatgtccctcccagctgccctaccttccagagcccatatcaatgcctgggtcagagccctgggaaggaactgctcagttaggacccagacggaaccatggaagccccagctcagcttctcttcctcctgctactctggctcccagataccaccagagaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggacagacttcactctcaccatcagcagcctgcagcctgaagattttgcagtttattactgtcagcaggattataacttacct

SEQ ID NO: 142311 - DNA, 445 bp, Homo sapiens; identical to SEQ ID NO: 142310
  Payload ID: 8076
  Gene Symbol: IGKV3-7
  Gene Name: immunoglobulin kappa variable 3-7 (non-functional)
  ENST ID: ENST00000633250
  CDS Start-End: 98-445

SEQ ID NO: 142312 - DNA, 444 bp, Homo sapiens
  Payload ID: 8077
  Gene Symbol: IGKV3D-11
  Gene Name: immunoglobulin kappa variable 3D-11
  ENST ID: ENST00000390277
  CDS Start-End: 98-444
gcatgtccctcccagctgccctaccttccagagcccatatcaatgcctgggtcagagctctggggaggaactgctcagttaggacccagacggaaccatggaagccccagcgcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcatcc

SEQ ID NO: 142313 - DNA, 324 bp, Homo sapiens
  Payload ID: 8077
  Gene Symbol: IGKV3D-11
  Gene Name: immunoglobulin kappa variable 3D-11
  ENST ID: ENST00000611740
  CDS Start-End: 1-324
cagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaac

SEQ ID NO: 142314 - DNA, 396 bp, Homo sapiens
  Payload ID: 8078
  Gene Symbol: IGKV3D-15
  Gene Name: immunoglobulin kappa variable 3D-15 (gene/pseudogene)
  ENST ID: ENST00000417279
  CDS Start-End: 50-396
gggtcagagctctggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccatcagggccactggcatcccagccaggttcagtggcagtgggtctgggacagagttcactctcaccatcagcatcctgcagtctgaagattttgcagtttattactgtcagcagtataataactggcctcc

SEQ ID NO: 142315 - DNA, 445 bp, Homo sapiens
  Payload ID: 8079
  Gene Symbol: IGKV3D-20
  Gene Name: immunoglobulin kappa variable 3D-20
  ENST ID: ENST00000390270
  CDS Start-End: 98-445
gcatgtccctcccagccgccctgcagtccagagcccatatcaatgcctgggtcagagctctggggaggaactgctcagttaggacccagagggaaccatggaaaccccagcgcagcttctcttcctcctgctactctggctcccagataccaccggagaaattgtgttgacgcagtctccagccaccctgtctttgtctccaggggaaagagccaccctctcctgcggggccagtcagagtgttagcagcagctacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacct

SEQ ID NO: 142316 - DNA, 384 bp, Homo sapiens
  Payload ID: 8080
  Gene Symbol: IGKV3D-7
  Gene Name: immunoglobulin kappa variable 3D-7
  ENST ID: ENST00000443397
  CDS Start-End: 26-384
gaggaactgctcagttaggacccagatggaaccatggaagccccagcacagcttcttcttcctcctgctactctggctcccagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcc

SEQ ID NO: 142317 - DNA, 333 bp, Homo sapiens
  Payload ID: 8080
  Gene Symbol: IGKV3D-7
  Gene Name: immunoglobulin kappa variable 3D-7
  ENST ID: ENST00000614332
  CDS Start-End: 1-333
cagcttcttttcctcctgctactctggctcccagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacct

SEQ ID NO: 142318 - DNA, 384 bp, Homo sapiens; identical to SEQ ID NO: 142316
  Payload ID: 8080
  Gene Symbol: IGKV3D-7
  Gene Name: immunoglobulin kappa variable 3D-7
  ENST ID: ENST00000627132
  CDS Start-End: 26-384

SEQ ID NO: 142319 - DNA, 538 bp, Homo sapiens
  Payload ID: 8081
  Gene Symbol: IGKV4-1
  Gene Name: immunoglobulin kappa variable 4-1
  Uniprot ID: P06312
  ENST ID: ENST00000390243
  CDS Start-End: 176-538
tttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcct

SEQ ID NO: 142320 - DNA, 408 bp, Homo sapiens
  Payload ID: 8082
  Gene Symbol: IGKV5-2
  Gene Name: immunoglobulin kappa variable 5-2
  Uniprot ID: P06315
  ENST ID: ENST00000390244
  CDS Start-End: 64-408
ataaaatctgtgctgtcaaactgattaggaactgactaccacctgcaggtcagggccaaggttatggggtcccaggttcacctcctcagcttcctcctcctttggatctctgataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccct

SEQ ID NO: 142321 - DNA, 408 bp, Homo sapiens; identical to SEQ ID NO: 142320
  Payload ID: 8082
  Gene Symbol: IGKV5-2
  Gene Name: immunoglobulin kappa variable 5-2
  Uniprot ID: P06315
  ENST ID: ENST00000632585
  CDS Start-End: 64-408

SEQ ID NO: 142322 - DNA, 406 bp, Homo sapiens
  Payload ID: 8083
  Gene Symbol: IGKV6-21
  Gene Name: immunoglobulin kappa variable 6-21 (non-functional)
  ENST ID: ENST00000390256
  CDS Start-End: 65-406
atcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttacct

SEQ ID NO: 142323 - DNA, 406 bp, Homo sapiens; identical to SEQ ID NO: 142322
  Payload ID: 8083
  Gene Symbol: IGKV6-21
  Gene Name: immunoglobulin kappa variable 6-21 (non-functional)
  ENST ID: ENST00000631699
  CDS Start-End: 65-406

SEQ ID NO: 142324 - DNA, 409 bp, Homo sapiens
  Payload ID: 8084
  Gene Symbol: IGKV6D-21
  Gene Name: immunoglobulin kappa variable 6D-21 (non-functional)
  ENST ID: ENST00000436451
  CDS Start-End: 68-409
ggtatcttaaaagaggttctttctctgggatgtggcatgagcaaaactgacaagtcaaggcaggaagatgtcgccatcacaactcattgggtttctgctgctctgggttccagcctccaggggtgaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccatctcaggggtcccctcgaggttcagtggcagtggatctgggacagatttcaccctcaccatcaatagcctggaagctgaagatgctgcagcgtattactgtcatcagagtagtagtttacct

SEQ ID NO: 142325 - DNA, 371 bp, Homo sapiens
  Payload ID: 8085
  Gene Symbol: IGKV6D-41
  Gene Name: immunoglobulin kappa variable 6D-41 (non-functional)
  ENST ID: ENST00000390271
  CDS Start-End: 27-371
agcaaaactgaagtcaaaacactgagatggtgtccccgttgcaattcctgcggcttctgctcctctgggttccagcctccaggggtgatgttgtgatgacacagtctccagctttcctctctgtgactccaggggagaaagtcaccatcacctgccaggccagtgaaggcattggcaactacttatactggtaccagcagaaaccagatcaagccccaaagctcctcatcaagtatgcttcccagtccatctcaggggtcccctcgaggttcagtggcagtggatctgggacagatttcacctttaccatcagtagcctggaagctgaagatgctgcaacatattactgtcagcagggcaataagcaccct

SEQ ID NO: 142326 - DNA, 460 bp, Homo sapiens
  Payload ID: 8086
  Gene Symbol: IGLC1
  Gene Name: immunoglobulin lambda constant 1 (Mcg marker)
  ENST ID: ENST00000390321
  CDS Start-End: 1-320
gtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaa

SEQ ID NO: 142327 - DNA, 462 bp, Homo sapiens
  Payload ID: 8087
  Gene Symbol: IGLC2
  Gene Name: immunoglobulin lambda constant 2 (Kern-Oz- marker)
  ENST ID: ENST00000390323
  CDS Start-End: 1-320
gtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaa

SEQ ID NO: 142328 - DNA, 462 bp, Homo sapiens
  Payload ID: 8088
  Gene Symbol: IGLC3
  Gene Name: immunoglobulin lambda constant 3 (Kern-Oz+ marker)
  ENST ID: ENST00000390325
  CDS Start-End: 1-320
gtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcataggttctcatccctcaccccccaccacgggagactagagctgcaggatcccaggggaggggtctctcctcccaccccaaggcatcaagcccttctccctgcactcaataaaccctcaataaatattctcattgtcaatcagaaa

SEQ ID NO: 142329 - DNA, 441 bp, Homo sapiens
  Payload ID: 8089
  Gene Symbol: IGLC7
  Gene Name: immunoglobulin lambda constant 7
  ENST ID: ENST00000390331
  CDS Start-End: 1-320
gtcagcccaaggctgccccctcggtcactctgttcccaccctcctctgaggagcttcaagccaacaaggccacactggtgtgtctcgtaagtgacttcaacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttaggcccccgaccctcaccccacccacaggggcctggagctgcaggttcccaggggaggggtctctgcccccatcccaagtcatccagcccttctcaataaatatcctcatcgtcaacgagaaa

SEQ ID NO: 142330 - DNA, 127 bp, Homo sapiens
  Payload ID: 8090
  Gene Symbol: IGLJ1
  Gene Name: immunoglobulin lambda joining 1
  ENST ID: ENST00000390320
  CDS Start-End: 1-127
cccagcaggctcctgctccagcccagcccccagagagcagaccccaggtgctggccccgggggttttggtctgagcctcagtcactgtgttatgtcttcggaactgggaccaaggtcaccgtcctag

SEQ ID NO: 142331 - DNA, 175 bp, Homo sapiens
  Payload ID: 8091
  Gene Symbol: IGLJ2
  Gene Name: immunoglobulin lambda joining 2
  ENST ID: ENST00000390322
  CDS Start-End: 34-175
gtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctag

SEQ ID NO: 142332 - DNA, 176 bp, Homo sapiens
  Payload ID: 8092
  Gene Symbol: IGLJ3
  Gene Name: immunoglobulin lambda joining 3
  ENST ID: ENST00000390324
  CDS Start-End: 26-176
gtgtgggggccatgtggactccctcatgagcagatgccaccaggaccactggtcccagcttcctccttcacagctgcagtgggggctggggctaggggcatcccagggagggtttttgtatgagcctgtgtcacagtgttgggtgttcggcggagggaccaagctgaccgtcctag

SEQ ID NO: 142333 - DNA, 33 bp, Homo sapiens
  Payload ID: 8093
  Gene Symbol: IGLJ4
  Gene Name: immunoglobulin lambda joining 4 (non-functional)
  ENST ID: ENST00000390326
  CDS Start-End: 1-33
gtatttggtggaggaacccagctgatcatttta

SEQ ID NO: 142334 - DNA, 72 bp, Homo sapiens
  Payload ID: 8094
  Gene Symbol: IGLJ5
  Gene Name: immunoglobulin lambda joining 5 (non-functional)
  ENST ID: ENST00000390327
  CDS Start-End: 1-72
cagagagggtttttgtatgagcctgtgtcacagcactgggtgtttggtgaggggaccgagctgaccgtccta

SEQ ID NO: 142335 - DNA, 70 bp, Homo sapiens
  Payload ID: 8095
  Gene Symbol: IGLJ6
  Gene Name: immunoglobulin lambda joining 6
  ENST ID: ENST00000390328
  CDS Start-End: 1-70
ggagggtttgtgtgcagggttatatcacagtgtaatgtgttcggcagtggcaccaaggtgaccgtcctcg

SEQ ID NO: 142336 - DNA, 46 bp, Homo sapiens
  Payload ID: 8096
  Gene Symbol: IGLJ7
  Gene Name: immunoglobulin lambda joining 7
  ENST ID: ENST00000390330
  CDS Start-End: 1-46
tcactgtgtgctgtgttcggaggaggcacccagctgaccgtcctcg

SEQ ID NO: 142337 - DNA, 365 bp, Homo sapiens
  Payload ID: 8097
  Gene Symbol: IGLV10-54
  Gene Name: immunoglobulin lambda variable 10-54
  ENST ID: ENST00000390287
  CDS Start-End: 14-365
gggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctc

SEQ ID NO: 142338 - DNA, 426 bp, Homo sapiens
  Payload ID: 8098
  Gene Symbol: IGLV11-55
  Gene Name: immunoglobulin lambda variable 11-55 (non-functional)
  ENST ID: ENST00000390286
  CDS Start-End: 13-426
gctgtgtccactatggccctgactcctctcctcctcctgctcctctctcactgcacaggttccctctcccggcccgtgctgactcagccgccctccctgtctgcatccccgggagcaacagccagactcccctgcaccctgagcagtgacctcagtgttggtggtaaaaacatgttctggtaccagcagaagctagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaa

SEQ ID NO: 142339 - DNA, 393 bp, Homo sapiens
  Payload ID: 8099
  Gene Symbol: IGLV1-36
  Gene Name: immunoglobulin lambda variable 1-36
  ENST ID: ENST00000390301
  CDS Start-End: 41-393
gctgcgggtagagaagacaggactcaggacaatctccagcatggcctggtcccctctcttcctcaccctcatcactcactgtgcagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcc

SEQ ID NO: 142340 - DNA, 351 bp, Homo sapiens
  Payload ID: 8099
  Gene Symbol: IGLV1-36
  Gene Name: immunoglobulin lambda variable 1-36
  ENST ID: ENST00000615359
  CDS Start-End: 1-351
atgacctgctcccctctcctcctcacccttctcattcactgcacagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggt

SEQ ID NO: 142341 - DNA, 393 bp, Homo sapiens; identical to SEQ ID NO: 142339
  Payload ID: 8099
  Gene Symbol: IGLV1-36
  Gene Name: immunoglobulin lambda variable 1-36
  ENST ID: ENST00000618026
  CDS Start-End: 41-393

SEQ ID NO: 142342 - DNA, 407 bp, Homo sapiens
  Payload ID: 8100
  Gene Symbol: IGLV1-40
  Gene Name: immunoglobulin lambda variable 1-40
  ENST ID: ENST00000390299
  CDS Start-End: 52-407
gctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttc

SEQ ID NO: 142343 - DNA, 407 bp, Homo sapiens; identical to SEQ ID NO: 142342
  Payload ID: 8100
  Gene Symbol: IGLV1-40
  Gene Name: immunoglobulin lambda variable 1-40
  ENST ID: ENST00000610349
  CDS Start-End: 52-407

SEQ ID NO: 142344 - DNA, 467 bp, Homo sapiens
  Payload ID: 8101
  Gene Symbol: IGLV1-44
  Gene Name: immunoglobulin lambda variable 1-44
  ENST ID: ENST00000390297
  CDS Start-End: 115-467
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcc

SEQ ID NO: 142345 - DNA, 466 bp, Homo sapiens
  Payload ID: 8101
  Gene Symbol: IGLV1-44
  Gene Name: immunoglobulin lambda variable 1-44
  ENST ID: ENST00000628287
  CDS Start-End: 115-466
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtc

SEQ ID NO: 142346 - DNA, 407 bp, Homo sapiens
  Payload ID: 8102
  Gene Symbol: IGLV1-47
  Gene Name: immunoglobulin lambda variable 1-47
  ENST ID: ENST00000390294
  CDS Start-End: 57-407
ggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggt

SEQ ID NO: 142347 - DNA, 405 bp, Homo sapiens
  Payload ID: 8103
  Gene Symbol: IGLV1-50
  Gene Name: immunoglobulin lambda variable 1-50 (non-functional)
  ENST ID: ENST00000390291
  CDS Start-End: 52-405
gctctgcttcagctgtgggcacaggaggcagcactcaggacaatctccagcatggcctggtcttctctcctcctcactctcctcgctcactgcacagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgct

SEQ ID NO: 142348 - DNA, 400 bp, Homo sapiens
  Payload ID: 8104
  Gene Symbol: IGLV1-51
  Gene Name: immunoglobulin lambda variable 1-51
  ENST ID: ENST00000390290
  CDS Start-End: 37-400
tgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctcc

SEQ ID NO: 142349 - DNA, 400 bp, Homo sapiens
  Payload ID: 8105
  Gene Symbol: IGLV2-11
  Gene Name: immunoglobulin lambda variable 2-11
  ENST ID: ENST00000390314
  CDS Start-End: 43-400
tgctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccaca

SEQ ID NO: 142350 - DNA, 402 bp, Homo sapiens
  Payload ID: 8106
  Gene Symbol: IGLV2-14
  Gene Name: immunoglobulin lambda variable 2-14
  ENST ID: ENST00000390312
  CDS Start-End: 42-402
gctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtg

SEQ ID NO: 142351 - DNA, 374 bp, Homo sapiens
  Payload ID: 8107
  Gene Symbol: IGLV2-18
  Gene Name: immunoglobulin lambda variable 2-18
  ENST ID: ENST00000390310
  CDS Start-End: 14-374
gaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagag

SEQ ID NO: 142352 - DNA, 502 bp, Homo sapiens
  Payload ID: 8108
  Gene Symbol: IGLV2-23
  Gene Name: immunoglobulin lambda variable 2-23
  ENST ID: ENST00000390306
  CDS Start-End: 163-502
tctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcag

SEQ ID NO: 142353 - DNA, 412 bp, Homo sapiens
  Payload ID: 8109
  Gene Symbol: IGLV2-33
  Gene Name: immunoglobulin lambda variable 2-33 (non-functional)
  ENST ID: ENST00000390302
  CDS Start-End: 59-412
ggctagaggcaggcccggtgctggggtctcaaggcagcgctctcgggacatctccaccatggcctgggctctgctcctcctcaccctcctcactcagggcacagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttc

SEQ ID NO: 142354 - DNA, 412 bp, Homo sapiens; identical to SEQ ID NO: 142353
  Payload ID: 8109
  Gene Symbol: IGLV2-33
  Gene Name: immunoglobulin lambda variable 2-33 (non-functional)
  ENST ID: ENST00000629472
  CDS Start-End: 59-412

SEQ ID NO: 142355 - DNA, 521 bp, Homo sapiens
  Payload ID: 8110
  Gene Symbol: IGLV2-8
  Gene Name: immunoglobulin lambda variable 2-8
  ENST ID: ENST00000620395
  CDS Start-End: 50-521
tctctaagcccaggcccaagtgagggtggggtgagaagaggagctcaggatgcagatttgcatggaggtcccgcccttctctgaggcagaggggataagacagggctgggggcaggcccagtgctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccaca

SEQ ID NO: 142356 - DNA, 398 bp, Homo sapiens
  Payload ID: 8111
  Gene Symbol: IGLV3-1
  Gene Name: immunoglobulin lambda variable 3-1
  ENST ID: ENST00000390319
  CDS Start-End: 53-398
aagaacctgcccagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacaca

SEQ ID NO: 142357 - DNA, 386 bp, Homo sapiens
  Payload ID: 8112
  Gene Symbol: IGLV3-10
  Gene Name: immunoglobulin lambda variable 3-10
  ENST ID: ENST00000390315
  CDS Start-End: 36-386
gtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcaca

SEQ ID NO: 142358 - DNA, 360 bp, Homo sapiens
  Payload ID: 8113
  Gene Symbol: IGLV3-12
  Gene Name: immunoglobulin lambda variable 3-12
  ENST ID: ENST00000390313
  CDS Start-End: 10-360
gcctcagccatggcctggacccctctcctcctcagcctcctcgctcactgcacaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacg

SEQ ID NO: 142359 - DNA, 375 bp, Homo sapiens
  Payload ID: 8114
  Gene Symbol: IGLV3-16
  Gene Name: immunoglobulin lambda variable 3-16
  ENST ID: ENST00000390311
  CDS Start-End: 39-375
tctgtgggtccaggaggcacagctctgggaatctcaccatggcctggatccctctcctgctccccctcctcactctctgcacaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtg

SEQ ID NO: 142360 - DNA, 377 bp, Homo sapiens
  Payload ID: 8115
  Gene Symbol: IGLV3-19
  Gene Name: immunoglobulin lambda variable 3-19
  ENST ID: ENST00000390309
  CDS Start-End: 41-377
agctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtg

SEQ ID NO: 142361 - DNA, 602 bp, Homo sapiens
  Payload ID: 8116
  Gene Symbol: IGLV3-21
  Gene Name: immunoglobulin lambda variable 3-21
  ENST ID: ENST00000390308
  CDS Start-End: 252-602
gcacagaggagctgtgccctggaatggggcctgtacctgtccaaggcttgtgccgtcccctgtgggagatgagaagcgtccctgcattgggctcttggggacccgtcttggacatgaatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacg

SEQ ID NO: 142362 - DNA, 409 bp, Homo sapiens
  Payload ID: 8117
  Gene Symbol: IGLV3-22
  Gene Name: immunoglobulin lambda variable 3-22 (gene/pseudogene)
  ENST ID: ENST00000390307
  CDS Start-End: 65-409
aagagaggcctgggaagcccagctgtgctgtgggctcaggaggcagagctgtgggtgtctcaccatggcatgggccacactcctgctcccactcctcaacctctacacaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctca

SEQ ID NO: 142363 - DNA, 380 bp, Homo sapiens
  Payload ID: 8118
  Gene Symbol: IGLV3-25
  Gene Name: immunoglobulin lambda variable 3-25
  ENST ID: ENST00000390305
  CDS Start-End: 44-380
gctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtg

SEQ ID NO: 142364 - DNA, 377 bp, Homo sapiens
  Payload ID: 8119
  Gene Symbol: IGLV3-27
  Gene Name: immunoglobulin lambda variable 3-27
  ENST ID: ENST00000390304
  CDS Start-End: 39-377
gctgtaggctcaggaggcagagctctgaatgtctcaccatggcctggatccctctcctgctccccctcctcattctctgcacagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaat

SEQ ID NO: 142365 - DNA, 383 bp, Homo sapiens
  Payload ID: 8120
  Gene Symbol: IGLV3-32
  Gene Name: immunoglobulin lambda variable 3-32 (non-functional)
  ENST ID: ENST00000390303
  CDS Start-End: 40-383
gctgtggactcagaggcagagctctggggcatttccattatggcctggacccctcccctgctcgtcctcactctctgcacaggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctactcaact

SEQ ID NO: 142366 - DNA, 383 bp, Homo sapiens; identical to SEQ ID NO: 142365
  Payload ID: 8120
  Gene Symbol: IGLV3-32
  Gene Name: immunoglobulin lambda variable 3-32 (non-functional)
  ENST ID: ENST00000627634
  CDS Start-End: 40-383

SEQ ID NO: 142367 - DNA, 461 bp, Homo sapiens
  Payload ID: 8121
  Gene Symbol: IGLV3-9
  Gene Name: immunoglobulin lambda variable 3-9 (gene/pseudogene)
  ENST ID: ENST00000390316
  CDS Start-End: 116-461
cttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacaca

SEQ ID NO: 142368 - DNA, 403 bp, Homo sapiens
  Payload ID: 8122
  Gene Symbol: IGLV4-3
  Gene Name: immunoglobulin lambda variable 4-3
  ENST ID: ENST00000390318
  CDS Start-End: 33-401
ctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagc

SEQ ID NO: 142369 - DNA, 362 bp, Homo sapiens
  Payload ID: 8123
  Gene Symbol: IGLV4-60
  Gene Name: immunoglobulin lambda variable 4-60
  ENST ID: ENST00000390284
  CDS Start-End: 1-362
atggcctggaccccactcctcctcctcttccctctcctcctccactgcacagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactca

SEQ ID NO: 142370 - DNA, 419 bp, Homo sapiens
  Payload ID: 8124
  Gene Symbol: IGLV4-69
  Gene Name: immunoglobulin lambda variable 4-69
  ENST ID: ENST00000390282
  CDS Start-End: 61-419
agggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattca

SEQ ID NO: 142371 - DNA, 374 bp, Homo sapiens
  Payload ID: 8125
  Gene Symbol: IGLV5-37
  Gene Name: immunoglobulin lambda variable 5-37
  ENST ID: ENST00000390300
  CDS Start-End: 6-374
ccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttct

SEQ ID NO: 142372 - DNA, 374 bp, Homo sapiens; identical to SEQ ID NO: 142371
  Payload ID: 8125
  Gene Symbol: IGLV5-37
  Gene Name: immunoglobulin lambda variable 5-37
  ENST ID: ENST00000628968
  CDS Start-End: 6-374

SEQ ID NO: 142373 - DNA, 397 bp, Homo sapiens
  Payload ID: 8126
  Gene Symbol: IGLV5-45
  Gene Name: immunoglobulin lambda variable 5-45
  ENST ID: ENST00000390296
  CDS Start-End: 29-397
actgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgtgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 142374 - DNA, 397 bp, Homo sapiens
  Payload ID: 8126
  Gene Symbol: IGLV5-45
  Gene Name: immunoglobulin lambda variable 5-45
  ENST ID: ENST00000626489
  CDS Start-End: 29-397
actgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 142375 - DNA, 369 bp, Homo sapiens
  Payload ID: 8127
  Gene Symbol: IGLV5-48
  Gene Name: immunoglobulin lambda variable 5-48 (non-functional)
  ENST ID: ENST00000390293
  CDS Start-End: 1-318
atggcctggactcctctccttctcctgttcctctctcactgcacaggttccctctcgcaggctgtgctgactcagccaacttccctctcagcatctcctggagcatcagccagactcacctgcaccttgcgcagtggcatcagtgttggtagctacaggatatactggtaccagcagaagccagggagtcctcccaggtatctcctgaactactactcagactcagataagcaccagggctctggagtccccagccgcttctctggatccaaagatgcttcgaccaatgcagggattttattcatctctgggctctagtctgaggatgaggctgactattactgtatgatttggcacagcagtgcttct

SEQ ID NO: 142376 - DNA, 379 bp, Homo sapiens
  Payload ID: 8128
  Gene Symbol: IGLV5-52
  Gene Name: immunoglobulin lambda variable 5-52
  ENST ID: ENST00000390289
  CDS Start-End: 6-379
ccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactca

SEQ ID NO: 142377 - DNA, 623 bp, Homo sapiens
  Payload ID: 8129
  Gene Symbol: IGLV6-57
  Gene Name: immunoglobulin lambda variable 6-57
  ENST ID: ENST00000390285
  CDS Start-End: 87-533
tctgaggatacgcgtgacagataagaagggctggtgggatcagtcctggtggtagctcaggaagcagagcctggagcatctccactatggcctgggctccactacttctcaccctcctcgctcactgcacaggttcttgggccaattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccggagagggtagctctcccatctctcctgtctaagtgcttgaggtgaactttgcttatgacttcctcttttccttttcaaaataccaatctgtttttccaca

SEQ ID NO: 142378 - DNA, 385 bp, Homo sapiens
  Payload ID: 8130
  Gene Symbol: IGLV7-43
  Gene Name: immunoglobulin lambda variable 7-43
  ENST ID: ENST00000390298
  CDS Start-End: 35-385
tctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcag

SEQ ID NO: 142379 - DNA, 385 bp, Homo sapiens; identical to SEQ ID NO: 142378
  Payload ID: 8130
  Gene Symbol: IGLV7-43
  Gene Name: immunoglobulin lambda variable 7-43
  ENST ID: ENST00000618644
  CDS Start-End: 35-385

SEQ ID NO: 142380 - DNA, 385 bp, Homo sapiens
  Payload ID: 8131
  Gene Symbol: IGLV7-46
  Gene Name: immunoglobulin lambda variable 7-46 (gene/pseudogene)
  ENST ID: ENST00000390295
  CDS Start-End: 35-385
tctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcgg

SEQ ID NO: 142381 - DNA, 414 bp, Homo sapiens
  Payload ID: 8132
  Gene Symbol: IGLV8-61
  Gene Name: immunoglobulin lambda variable 8-61
  ENST ID: ENST00000390283
  CDS Start-End: 47-414
gaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttc

SEQ ID NO: 142382 - DNA, 409 bp, Homo sapiens
  Payload ID: 8133
  Gene Symbol: IGLV9-49
  Gene Name: immunoglobulin lambda variable 9-49
  ENST ID: ENST00000427632
  CDS Start-End: 38-409
gagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgtgtaa

SEQ ID NO: 142383 - DNA, 716 bp, Homo sapiens
  Payload ID: 8134
  Gene Symbol: IGLL1
  Gene Name: immunoglobulin lambda-like polypeptide 1
  Uniprot ID: P15814
  ENST ID: ENST00000249053
  CDS Start-End: 50-304
gagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 142384 - DNA, 901 bp, Homo sapiens
  Payload ID: 8134
  Gene Symbol: IGLL1
  Gene Name: immunoglobulin lambda-like polypeptide 1
  Uniprot ID: P15814
  ENST ID: ENST00000330377
  CDS Start-End: 119-760
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggttcctgctccagcgcggctcctggactggccccaggtgctggccccgggggtttcaatccaagcataactcagtgacgcatgtgtttggcagcgggacccagctcaccgttttaagtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 142385 - DNA, 654 bp, Homo sapiens
  Payload ID: 8134
  Gene Symbol: IGLL1
  Gene Name: immunoglobulin lambda-like polypeptide 1
  ENST ID: ENST00000438703
  CDS Start-End: 113-654
atggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcagcaggttcctgctccagcgcggctcctggactggccccaggtgctggccccgggggtttcaatccaagcataactcagtgacgcatgtgtttggcagcgggacccagctcaccgttttaagtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgag

SEQ ID NO: 142386 - DNA, 1050 bp, Homo sapiens
  Payload ID: 8135
  Gene Symbol: IGLL5
  Gene Name: immunoglobulin lambda-like polypeptide 5
  Uniprot ID: B9A064
  ENST ID: ENST00000526893
  CDS Start-End: 275-919
agccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgac

SEQ ID NO: 142387 - DNA, 882 bp, Homo sapiens
  Payload ID: 8135
  Gene Symbol: IGLL5
  Gene Name: immunoglobulin lambda-like polypeptide 5
  Uniprot ID: B9A064
  ENST ID: ENST00000531372
  CDS Start-End: 226-480
ggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgac

SEQ ID NO: 142388 - DNA, 1335 bp, Homo sapiens
  Payload ID: 8135
  Gene Symbol: IGLL5
  Gene Name: immunoglobulin lambda-like polypeptide 5
  ENST ID: ENST00000532223
  CDS Start-End: 275-922
agccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcagcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaa

SEQ ID NO: 142389 - DNA, 3961 bp, Homo sapiens
  Payload ID: 8136
  Gene Symbol: IGHMBP2
  Gene Name: immunoglobulin mu binding protein 2
  Uniprot ID: P38935
  ENST ID: ENST00000255078
  CDS Start-End: 112-3093
gcgaaccgcgtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgagggacctcccaggtgtggctgccacagaagagacgggtgtgcccctgctcttggtggacaccgccggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacac

SEQ ID NO: 142390 - DNA, 785 bp, Homo sapiens
  Payload ID: 8136
  Gene Symbol: IGHMBP2
  Gene Name: immunoglobulin mu binding protein 2
  ENST ID: ENST00000539224
  CDS Start-End: 57-635
ccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattca

SEQ ID NO: 142391 - DNA, 479 bp, Homo sapiens
  Payload ID: 8136
  Gene Symbol: IGHMBP2
  Gene Name: immunoglobulin mu binding protein 2
  ENST ID: ENST00000544541
  CDS Start-End: 63-152
gtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctccca

SEQ ID NO: 142392 - DNA, 477 bp, Homo sapiens
  Payload ID: 8136
  Gene Symbol: IGHMBP2
  Gene Name: immunoglobulin mu binding protein 2
  ENST ID: ENST00000545146
  CDS Start-End: 28-303
ttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgatatcgtgggcctgtacgatgctgctaatgagggcagtcagctgg

SEQ ID NO: 142393 - DNA, 2371 bp, Homo sapiens
  Payload ID: 8137
  Gene Symbol: ISLR
  Gene Name: immunoglobulin superfamily containing leucine-rich repeat
  Uniprot ID: O14498
  ENST ID: ENST00000249842
  CDS Start-End: 358-1644
aaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccc

SEQ ID NO: 142394 - DNA, 2175 bp, Homo sapiens
  Payload ID: 8137
  Gene Symbol: ISLR
  Gene Name: immunoglobulin superfamily containing leucine-rich repeat
  Uniprot ID: O14498
  ENST ID: ENST00000395118
  CDS Start-End: 162-1448
gcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccc

SEQ ID NO: 142395 - DNA, 585 bp, Homo sapiens
  Payload ID: 8137
  Gene Symbol: ISLR
  Gene Name: immunoglobulin superfamily containing leucine-rich repeat
  ENST ID: ENST00000560862
  CDS Start-End: 35-585
gcacaaggggcctcgtctgggccaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactg

SEQ ID NO: 142396 - DNA, 570 bp, Homo sapiens
  Payload ID: 8137
  Gene Symbol: ISLR
  Gene Name: immunoglobulin superfamily containing leucine-rich repeat
  ENST ID: ENST00000559510
  CDS Start-End: 130-570
acaatccctagcttggagccgtccagggggcatctgcttcttccacaacccacaactgaggccccagaaatcccagctgcgtttgggctgagcctctggcctcacccaagtcagctgagaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgct

SEQ ID NO: 142397 - DNA, 4817 bp, Homo sapiens
  Payload ID: 8138
  Gene Symbol: ISLR2
  Gene Name: immunoglobulin superfamily containing leucine-rich repeat 2
  Uniprot ID: Q6UXK2
  ENST ID: ENST00000361742
  CDS Start-End: 770-3007
ctcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 142398 - DNA, 2306 bp, Homo sapiens
  Payload ID: 8138
  Gene Symbol: ISLR2
  Gene Name: immunoglobulin superfamily containing leucine-rich repeat 2
  ENST ID: ENST00000419208
  CDS Start-End: 86-1090
cttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttcc

SEQ ID NO: 142399 - DNA, 4259 bp, Homo sapiens
  Payload ID: 8138
  Gene Symbol: ISLR2
  Gene Name: immunoglobulin superfamily containing leucine-rich repeat 2
  Uniprot ID: Q6UXK2
  ENST ID: ENST00000435464
  CDS Start-End: 214-2451
atatcagcccagatccaggcaaaaatgggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttg

SEQ ID NO: 142400 - DNA, 2812 bp, Homo sapiens
  Payload ID: 8138
  Gene Symbol: ISLR2
  Gene Name: immunoglobulin superfamily containing leucine-rich repeat 2
  Uniprot ID: Q6UXK2
  ENST ID: ENST00000453268
  CDS Start-End: 441-2678
aacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaacctt

SEQ ID NO: 142401 - DNA, 586 bp, Homo sapiens
  Payload ID: 8138
  Gene Symbol: ISLR2
  Gene Name: immunoglobulin superfamily containing leucine-rich repeat 2
  ENST ID: ENST00000565332
  CDS Start-End: 245-586
aacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagcttt

SEQ ID NO: 142402 - DNA, 636 bp, Homo sapiens
  Payload ID: 8138
  Gene Symbol: ISLR2
  Gene Name: immunoglobulin superfamily containing leucine-rich repeat 2
  ENST ID: ENST00000569886
  CDS Start-End: 369-636
attagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcagggggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccg

SEQ ID NO: 142403 - DNA, 623 bp, Homo sapiens
  Payload ID: 8138
  Gene Symbol: ISLR2
  Gene Name: immunoglobulin superfamily containing leucine-rich repeat 2
  ENST ID: ENST00000567206
  CDS Start-End: 609-623
atcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaaggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgg

SEQ ID NO: 142404 - DNA, 630 bp, Homo sapiens
  Payload ID: 8138
  Gene Symbol: ISLR2
  Gene Name: immunoglobulin superfamily containing leucine-rich repeat 2
  ENST ID: ENST00000561740
  CDS Start-End: 217-630
cttatatcagcccagatccaggcaaaaatgggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctg

SEQ ID NO: 142405 - DNA, 2824 bp, Homo sapiens
  Payload ID: 8138
  Gene Symbol: ISLR2
  Gene Name: immunoglobulin superfamily containing leucine-rich repeat 2
  Uniprot ID: Q6UXK2
  ENST ID: ENST00000565159
  CDS Start-End: 502-2739
gggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcc

SEQ ID NO: 142406 - DNA, 2780 bp, Homo sapiens
  Payload ID: 8138
  Gene Symbol: ISLR2
  Gene Name: immunoglobulin superfamily containing leucine-rich repeat 2
  Uniprot ID: Q6UXK2
  ENST ID: ENST00000565540
  CDS Start-End: 117-2354
agatcccacatctcaagtcgtgcagtgcaggtcctcctattgcttctctgctgggtttcggtcacagtggagggctgtatgcacacacaggcacatgcctgtgttcttgagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaa

SEQ ID NO: 142407 - DNA, 4479 bp, Homo sapiens
  Payload ID: 8139
  Gene Symbol: IGDCC3
  Gene Name: immunoglobulin superfamily, DCC subclass, member 3
  Uniprot ID: Q8IVU1
  ENST ID: ENST00000327987
  CDS Start-End: 253-2697
agcggtgcgagtgtggagcgcgcaccccgggcgaggctgacagatcgcccgggtgggtgcaagatggcgcaagcggcgctccccctgcgccccccgcgctgctgagcaggcatgcggccccagtcccccaccgcctgggctcggccccggccggagccccagccccggccccggcgccggccccgcgggacgctgtgagccgcgagaggcccgggagccgcgcgtcgccgagccgagctgaccgagagccccatggctgtgcagcgcgccgcgtctccgcgccgcccgcccgccccgctctggccccggctcctgctgccgctgctgttgctgctgctgcccgcgccgagcgagggtcttggccactctgctgaactggcatttgctgtggagccaagtgatgatgttgccgtccccgggcagcctatagtgctggactgcagggtggaggggacccctccagtgcgaatcacctggaggaagaatggggtagagctgccagagagtacccactccaccttgctggccaatgggtccttgatgatccgtcacttcaggctggagccgggaggcagcccttcggatgaaggtgactatgagtgtgtggcccagaaccgctttgggctggtggtcagccggaaggctcgcatccaagctgcaaccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggaaaaccagctgtcccctccacagggtccccggagccagagggaccctggcattctagccctaaatggggcgagacggggacagcggggccagctgggccgagacgagaaacgtgtggatatgaaggagctggagcagctgttccccccggccagcgcagcagggcagccggaccccagacccacacaggatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttggatggtcctgggggctccccagcatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctcagccggaatgaatgtcctggggggcagtggggcggtggcctcagcccccttaccccacagagcccgaatgcactcctacctcaagtccccttgctggggaccccctctcccttcccacactgttgtccagagtaaaaaaaaaaaaaaaaaaaaaagcacttccccgtttccaggtgtgaaagaaaaaaaaaagcacttccccatttccagatgtgaaagaaaatgtctacctcaaggctcgctggctctgtgggctgtgttgtcactggacctgcctccccgcccctcctgcccacagcccacctacctctcctgcagaggagaggccagaggttgggccaccaaggggaactcttgtggcctacagaaatagaaatggattgggcagagaaaaaatgtgaaagcagccaaaaatgagaggaaatttgttccttgaagtataaattgtccaaacgagccacctcccagcacaccgcctgtccccgtcttgtctgtccactcccattttgagccagcccatccttgatggggatgcccatgaggaacctgggcttgggagggtggcatcagctggccgcctgcctcctgtcctgcaggcccggcccctggaatgtaccatgtgtgggatgggtgtgtgggagggtgagggggtgtgggtgtcccctgcagaggcgccccagcctcaggcacccagccagcctgatccacccctcgacaggggagcatccactgtcagcagccatggccggaagctatttttatacaaggtgtgttaagggttatgttcttgtgactttttgttactcttttctgttgtgttgttctttgaactacttagttaaagaagaagaaaagaaaaccaaggaaacaaatacctatttttggttatactcagaaacatttttttaaatagcagaagaaaaactttttttaaagaaaaaagataagtgtattccttaagaatgagaccataaatatccctgacccccaatcctctagggacacctccaccctgaactttagttaattagctgaagaagatagaatttgtggtgttttcctagaaaactagagctgtgtccgcgtggacttggggaagggtagtcccttcccttctcccaaatgatgtgtggatgcccagggctccacaaagctccaaggcagtgccccctctgttcccaaagcagcttctctcgggagcctccctctcccttgggaagggtgcggctggggcaggagggggctggggggccacctggccttacttgggttttgtcacactctgctcattttgactgaataaaagtcctgttgccaaagtgaa

SEQ ID NO: 142408 - DNA, 564 bp, Homo sapiens
  Payload ID: 8139
  Gene Symbol: IGDCC3
  Gene Name: immunoglobulin superfamily, DCC subclass, member 3
  ENST ID: ENST00000559058
  CDS Start-End: 154-564
cgcgagtgcgccggggccgggcccagctggggaatccgaggctctgggggagggggtggcgggaaatggtgcctcgctcgccccagcgacatcaaaccctcgtttggcgtgcgaggacaatggctgtcttattttctccattcgccgcgcacaatgccggattctctcattcacccgcggtggtgcgagcgagccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtc

SEQ ID NO: 142409 - DNA, 1783 bp, Homo sapiens
  Payload ID: 8139
  Gene Symbol: IGDCC3
  Gene Name: immunoglobulin superfamily, DCC subclass, member 3
  ENST ID: ENST00000558354
  CDS Start-End: 179-1783
atttccctcttcccgactcctctagtcccttcatcagtccaggctccccacagtgccccatcttccctcttcttttcccagtctttctctcctgccttctctacccgcatctctcccagccattgcctaaacctcggcagtcctttcaggttggtggcacacagctgggcactaagccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagat

SEQ ID NO: 142410 - DNA, 6508 bp, Homo sapiens
  Payload ID: 8140
  Gene Symbol: IGDCC4
  Gene Name: immunoglobulin superfamily, DCC subclass, member 4
  Uniprot ID: Q8TDY8
  ENST ID: ENST00000352385
  CDS Start-End: 211-3963
ctcgcccaagatggcgatggaggggcgggtgaggcggcagcggccctggcccccgcgccggccccagctcgggcccgggcccccgaggccgcgcccccgcccgcggcgccgcgcctccccgggccactgacgcccggcgcgctctccccccgcggcggcggccgaagcacggggaggcggcggcggcggcggcggcccgagcccagccccatggcgcggggggacgccggccgcggccgcgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaagacgggaagcccatctccacagatgtcatcgtcctgggccgcaccaacctactaattgccaacgcgcagccctggcactccggcgtctatgtctgccgcgccaacaagccccgcacgcgcgacttcgccactgcagccgctgagctccgtgtgctggcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttgcacaggaaaaggggtagctcatttcagtttgttttttctttaaattgaatcctcaagtcattttctgttcacctgccgcacagggacaagcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttttaaatggtggaatgtctctcagcacagttgcggcttcctcaaaccctgaaagcatctgtgtttattatactcgggtgtcactcactgttgatgtctgcacctacgtttccacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccagaaatgtggaattctcttttggaa

SEQ ID NO: 142411 - DNA, 4378 bp, Homo sapiens
  Payload ID: 8141
  Gene Symbol: IGSF1
  Gene Name: immunoglobulin superfamily, member 1
  Uniprot ID: Q8N6C5
  ENST ID: ENST00000361420
  CDS Start-End: 81-4091
gccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaa

SEQ ID NO: 142412 - DNA, 1786 bp, Homo sapiens
  Payload ID: 8141
  Gene Symbol: IGSF1
  Gene Name: immunoglobulin superfamily, member 1
  Uniprot ID: Q8N6C5
  ENST ID: ENST00000370900
  CDS Start-End: 107-835
gcctttctcctttccttcccggatcccagacctgcctcgatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaa

SEQ ID NO: 142413 - DNA, 1820 bp, Homo sapiens
  Payload ID: 8141
  Gene Symbol: IGSF1
  Gene Name: immunoglobulin superfamily, member 1
  Uniprot ID: Q8N6C5
  ENST ID: ENST00000370901
  CDS Start-End: 141-869
atgccgggcagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaa

SEQ ID NO: 142414 - DNA, 4594 bp, Homo sapiens
  Payload ID: 8141
  Gene Symbol: IGSF1
  Gene Name: immunoglobulin superfamily, member 1
  Uniprot ID: Q8N6C5
  ENST ID: ENST00000370903
  CDS Start-End: 284-4309
aggtgccaggcagagttggtgtaggtgggctccccgagcccggcgcagggaggggaggaggttggggcgggccggcaggcgggcgggggagagaggaaggcggggctcagagccgaagaggctgtccttagacagctcttctcatgccgggcagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcaatagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtgcaatttcttttgcaggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttc

SEQ ID NO: 142415 - DNA, 5413 bp, Homo sapiens
  Payload ID: 8141
  Gene Symbol: IGSF1
  Gene Name: immunoglobulin superfamily, member 1
  Uniprot ID: Q8N6C5
  ENST ID: ENST00000370904
  CDS Start-End: 1145-5128
ctccctgaccccttgcgcttcccgagtgaggcaatgcctcgccctgcttcggctcgcggacggtgcgcgcacccactgacctgcgcccactgtctggcactccctagtgagatgaacccggtacctcagatggaaatgcagaaatcacccgtcttctgcgtcgctcacgctgggagctgtagatcgcagctgttcctattcggccatcttggctcctccattctgcttttaagatacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcaacctcctgggttcaagtgatcctcctgcctctcagccttccgagtagctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattctgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttc

SEQ ID NO: 142416 - DNA, 4406 bp, Homo sapiens
  Payload ID: 8141
  Gene Symbol: IGSF1
  Gene Name: immunoglobulin superfamily, member 1
  Uniprot ID: Q8N6C5
  ENST ID: ENST00000370910
  CDS Start-End: 133-4116
cagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattctgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaa

SEQ ID NO: 142417 - DNA, 11067 bp, Homo sapiens
  Payload ID: 8142
  Gene Symbol: IGSF10
  Gene Name: immunoglobulin superfamily, member 10
  Uniprot ID: Q6WRI0
  ENST ID: ENST00000282466
  CDS Start-End: 1-7872
atgaaggtaaaaggcagaggaatcacctgcttgctggtctcctttgctgtgatctgcctggtcgccacccctgggggcaaggcctgtcctcgccgctgtgcctgttatatgcctacggaggtacactgcacatttcggtacctgacttccatcccagacagcatcccgcccaatgtggaacgcatcaatttaggatacaacagcttggttagattgatggaaacagatttttctggcctgaccaaactggagttactcatgcttcacagcaatggcattcacacaatccctgacaagaccttctcagatttgcaggccttgcaggtcttaaaaatgagctataataaagtccgaaaacttcagaaagatactttttatggcctcaggagcttgacacgattgcacatggaccacaacaatattgagtttataaacccagaggttttttatgggctcaactttctccgcctggtgcacttggaaggaaatcagctcactaagctccacccagatacatttgtctctttgagctacctccagatatttaaaatctctttcattaagttcctatacttgtctgataacttcctgacctccctccctcaagagatggtctcctatatgcctgacctagacagcctttacctgcatggaaacccatggacctgtgattgccatttaaagtggttgtctgactggatacaggagaagccagatgtaataaaatgcaaaaaagatagaagtccctctagtgctcagcagtgtccactttgcatgaaccctaggacttctaaaggcaagccgttagctatggtctcagctgcagctttccagtgtgccaagccaaccattgactcatccctgaaatcaaagagcctgactattctggaagacagtagttctgctttcatctctccccaaggtttcatggcaccctttggctccctcactttgaatatgacagatcagtctggaaatgaagctaacatggtctgcagtattcaaaagccctcaaggacatcacccattgcattcactgaagaaaatgactacatcgtgctaaatacttcattttcaacatttttggtgtgcaacatagattacggtcacattcagccagtgtggcaaattttggctttgtacagtgattctcctctgatactagaaaggagccacttgcttagtgaaacaccgcagctctattacaaatataaacaggtggctcctaagcctgaagacatttttaccaacatagaggcagatctcagagcagatccctcttggttaatgcaagaccaaatttccttgcagctgaacagaactgccaccacattcagtacattacagatccagtactccagtgatgctcaaatcactttaccaagagcagagatgaggccagtgaaacacaaatggactatgatttcaagggataacaatactaagctggaacatactgtcttggtaggtggaaccgttggcctgaactgcccaggccaaggagaccccaccccacacgtggattggcttctagctgatggaagtaaagtgagagccccttatgtcagtgaggatggacggatcctaatagacaaaagtggaaaattggaactccagatggctgatagttttgacacaggcgtatatcactgtataagcagcaattatgatgatgcagatattctcacctataggataactgtggtagaacctttggtcgaagcctatcaggaaaatgggattcatcacacagttttcattggtgaaacacttgatcttccatgccattctactggtatcccagatgcctctattagctgggttattccaggaaacaatgtgctctatcagtcatcaagagacaagaaagttctaaacaatggcacattaagaatattacaggtcaccccgaaagaccaaggttattatcgctgtgtggcagccaacccatcaggggttgattttttgattttccaagtttcagtcaagatgaaaggacaaaggcccttggagcatgatggagaaacagagggatctggacttgatgagtccaatcctattgctcatcttaaggagccaccaggtgcacaactccgtacatctgctctgatggaggctgaggttggaaaacacacctcaagcacaagtaagaggcacaactatcgggaattaacactccagcgacgtggagattcaacacatcgacgttttagggagaataggaggcatttccctccctctgctaggagaattgacccacaacattgggcggcactgttggagaaagctaaaaagaatgctatgccagacaagcgagaaaataccacagtgagcccacccccagtggtcacccaactcccaaacatacctggtgaagaagacgattcctcaggcatgctcgctctacatgaggaatttatggtcccggccactaaagctttgaaccttccagcaaggacagtgactgctgactccagaacaatatctgatagtcctatgacaaacataaattatggcacagaattctctcctgttgtgaattcacaaatactaccacctgaagaacccacagatttcaaactgtctactgctattaaaactacagccatgtcaaagaatataaacccaaccatgtcaagccaaatacaaggcacaaccaatcaacattcatccactgtctttccactgctacttggagcaactgaatttcaggactctgaccagatgggaagaggaagagagcatttccaaagtagacccccaataacagtaaggactatgatcaaagatgtcaatgtcaaaatgcttagtagcaccaccaacaaactattattagagtcagtaaataccacaaatagtcatcagacatctgtaagagaagtgagtgaacccaggcacaatcacttctattctcacactactcaaatacttagcacctccacgttcccttcagatccacacacagctgctcattctcagtttccgatccctagaaatagtacagttaacatcccgctgttcagacgctttgggaggcagaggaaaattggcggaagggggcggattatcagcccatatagaactccagttctgcgacggcatagatacagcattttcaggtcaacaaccagaggttcttctgaaaaaagcactactgcattctcagccacagtgctcaatgtgacatgtctgtcctgtcttcccagggagaggctcaccactgccacagcagcattgtcttttccaagtgctgctcccatcaccttccccaaagctgacattgctagagtcccatcagaagagtctacaactctagtccagaatccactattactacttgagaacaaacccagtgtagagaaaacaacacccacaataaaatatttcaggactgaaatttcccaagtgactccaactggtgcagtcatgacatatgctccaacatccatacccatggaaaaaactcacaaagtaaacgccagttacccacgtgtgtctagcaccaatgaagctaaaagagattcagtgattacatcgtcactttcaggtgctatcaccaagccaccaatgactattatagccattacaaggttttcaagaaggaaaattccctggcaacagaactttgtaaataaccataacccaaaaggcagattaaggaatcaacataaagttagtttacaaaaaagcacagctgtgatgcttcctaaaacatctcctgctttacccagagacaaagtctcccctttccatttcaccacactttcaacaagtgtgatgcaaattccatctaataccttgactaccgctcaccacactacgaccaaaacacacaatcctggaagtcttccaacaaagaaggagcttcccttcccaccccttaaccctatgcttcctagtattataagcaaagactcaagtacaaaaagcatcatatcaacgcaaacagcaataccagcaacaactcctaccttccctgcatctgtcatcacttatgaaacccaaacagagagatctagagcacaaacaatacaaagagaacaggagcctcaaaagaagaacaggactgacccaaacatctctccagaccagagttctggcttcactacacccactgctatgacacctcctgttctaaccacagccgaaacttcagtcaagcccagtgtctctgcattcactcattccccaccagaaaacacaactgggatttcaagcacaatcagttttcattcaagaactcttaatctgacagatgtgattgaagaactagcccaagcaagtactcagactttgaagagcacaattgcttctgaaacaactttgtccagcaaatcacaccagagtaccacaactaggaaagcaatcattagacactcaaccataccaccattcttgagcagcagtgctactctaatgccagttcccatctcccctccctttactcagagagcagttactgacaacgtggcgactcccatttccgggcttatgacaaatacagtggtcaagctgcacgaatcctcaaggcacaatgctaaaccacagcaattagtagcagaggttgcaacatcccccaaggttcacccaaatgccaagttcacaattggaaccactcacttcatctactctaatctgttacattctactcccatgccagcactaacaacagttaaatcacagaattctaaattaactccatctccctgggcagaaaaccaattttggcacaaaccatactcagaaattgctgaaaaaggcaaaaagccagaagtaagcatgttggctactacaggcctgtccgaggccaccactcttgtttcagattgggatggacagaagaacacaaagaagagtgactttgataagaaaccagttcaagaagcaacaacttccaaactccttccctttgactctttgtctaggtatatatttgaaaagcccaggatagttggaggaaaagctgcaagttttactattccagctaactcagatgcctttcttccctgtgaagctgttggaaatcccctgcccaccattcattggaccagagtcccatcaggacttgatttatctaagaggaaacagaatagcagggtccaggttctccccaatggtaccctgtccatccagagggtggaaattcaggaccgcggacagtacttgtgttccgcatccaatctgtttggcacagaccaccttcatgtcaccttgtctgtggtttcctatcctcccaggatcctggagagacgtaccaaagagatcacagttcattccggaagcactgtggaactgaagtgcagagcagaaggtaggccaagccctacagttacctggattcttgcaaaccaaacagttgtctcagaatcatcccagggaagtaggcaggctgtggtgacggttgacggaacattggtcctccacaatctcagtatttatgaccgtggcttttacaaatgtgtggccagcaacccaggtggccaggattcactgctggttaaaatacaagtcattgcagcaccacctgttattctagagcaaaggaggcaagtcattgtaggcacttggggtgaaagtttaaaactgccctgtactgcaaaaggaactcctcagcccagcgtttactgggtcctctctgatggcactgaagtgaaaccattacagtttaccaattccaagttgttcttattttcaaatgggactttgtatataagaaacctagcctcttcagacaggggcacttatgaatgcattgctaccagttccactggttcggagcgaagagtagtaatgcttacaatggaagagcgagtgaccagccccaggatagaagctgcatcccagaaaaggactgaagtgaattttggggacaaattactactgaactgctcagccactggggagcccaaaccccaaataatgtggaggttaccatccaaggctgtggtcgaccagcagcatagagtgggcagctggatccacgtctaccctaatggatccctgtttattggatcagtaacagaaaaagacagtggtgtctacttgtgtgtggcaagaaacaaaatgggggatgatctgatactgatgcatgttagcctaagactgaaacctgccaaaattgaccacaagcagtattttagaaagcaagtgctccatgggaaagatttccaagtagattgcaaagcttccggctccccagtgccagagatatcttggagtttgcctgatggaaccatgatcaacaatgcaatgcaagccgatgacagtggccacaggactaggagatatacccttttcaacaatggaactttatacttcaacaaagttggggtagcggaggaaggagattatacttgctatgcccagaacaccctagggaaagatgaaatgaaggtccacttaacagttataacagctgctccccggataaggcagagtaacaaaaccaacaagagaatcaaagctggagacacagctgtccttgactgtgaggtcactggggatcccaaaccaaaaatattttggttgctgccttccaatgacatgatttccttctccattgataggtacacatttcatgccaatgggtctttgaccatcaacaaagtgaaactgctcgattctggagagtacgtatgtgtagcccgaaatcccagtggggatgacaccaaaatgtacaaactggatgtggtctctaaacctccattaatcaatggtctgtatacaaacagaactgttattaaagccacagctgtgagacattccaaaaaacactttgactgcagagctgaagggacaccatctcctgaagtcatgtggatcatgccagacaatattttcctcacagccccatactatggaagcagaatcacagtccataaaaatggaaccttggaaattaggaatgtgaggctttcagattcagccgactttatctgtgtggcccgaaatgaaggtggagagagcgtgttggtagtacagttagaagtactggaaatgctgagaagaccgacatttagaaatccatttaatgaaaaaatagttgcccagctgggaaagtccacagcattgaattgctctgttgatggtaacccaccacctgaaataatctggattttaccaaatggcacacgattttccaatggaccacaaagttatcagtatctgatagcaagcaatggttcttttatcatttctaaaacaactcgggaggatgcaggaaaatatcgctgtgcagctaggaataaagttggctatattgagaaattagtcatattagaaattggccagaagccagttattcttacctatgcaccagggacagtaaaaggcatcagtggagaatctctatcactgcattgtgtgtctgatggaatccctaagccaaatatcaaatggactatgccaagtggttatgtagtagacaggcctcaaattaatgggaaatacatattgcatgacaatggcaccttagtcattaaagaagcaacagcttatgacagaggaaactatatctgtaaggctcaaaatagtgttggtcatacactgattactgttccagtaatgattgtagcctaccctccccgaattacaaatcgtccacccaggagtattgtcaccaggacaggggcagcctttcagctccactgtgtggccttgggagttcccaagccagaaatcacatgggagatgcctgaccactcccttctctcaacggcaagtaaagagaggacacatggaagtgagcagcttcacttacaaggtaccctagtcattcagaatccccaaacctccgattctgggatatacaaatgcacagcaaagaacccacttggtagtgattatgcagcaacgtatattcaagtaatctgacatgaaataataaagtcaacaacatctgggcagaatttattttttggaagaagtttaatcaaaggcagccataggcatgtaaatgaatttgaatacatttacagtattaaatttacaatgaacatgcaaaataaaaggacttgtaaataaatgcattatgaactgatgatactgatttatttaatggatctcaaaacaaacttttaacttaaggcacttttattttgccaacaaataacaataaacaaacattgaaacggttcactataaaataacaaatggctaatgtacctgaatttttcagtaaaaaaatgaacttctaataccagttgcctagtgtccacctcctatcaatgttacaagcatggcactcagaacagagacaatggaaaatattaaatctgcaatctttatgatgtaaatttaccatcctgatgtataaatattttgtggtttataaatttttttgctaaaacctacagaaaataagcactgaactgtcttatgattcaccatttgttcacactgaaaattttcattgatggggaatacaaaaatgttttaataactgcatttaaaaataaatgcaggctcacttttccacatgtaaaaagcaatgtaatacctgcacatcataaaatgtgaaaagggggttatttttgtccaaatacacccattaaaaaggttttaaaaatacaatgaaacttctttataactttaaaatctagctcaggcacccctggtttggagctgtttataaggaaatttttctgagcaggaatcgttgctctataagcatttcatttcattaattctttatgggatgggaaaatgcttgggagggtctaggtctattatatataatgaagtttcactgtatttaaaatctgatcaatcctacacaaaatgtgtttttgtaattcactgaatttatattacatgcttaattcaacctgaattaatttggggaatattaaatgattgatcttatctaaatctaggggtggggttttccagtgtaatttctccagcatctattcaaacattcacctagtacttacttaagaattataggagctttataaatgggaaaaaaatgccataggtcttagatatctcagtgcacaaaaccgagaattactaataagttagcccctgccaatcatttgagacatgtggaatagcgcccttgggttttcatcacactgactttcagttagccccatctcagcctaaaatgtgacctggttgcaacttatgtctgatgttagtaccctgtggctggaagtggtcaaagctacgcattgatctcctctacttccaggccaagaagggtaaatgcaatgactgacaaatgcaaccctattaagaaaaagcctacagtgtaaacaagagagtctatgggcttcttatatccaagaactgtgattgattgataggtatagctgactccatttgatttcaaggtcttgtctttaaggggagctggggtctcgctccatcttattctaaggtaatttcctctggtaaggtaaagtaccaggttctgccacagggctttaccttgtgaccatcttaatgcaaaagaatgcatttgcaagaaaagaaaaaaaaaaaaaaaaaaaagaaacctctcaagatacagaattaacagggagaaaatctgaagactaaagtaattctagttattttctttataatgcgcaggggtaaaacagcattcctcaactttcaatagaatcgtggaattaattagagtcgtagcataacttcctcacctaaaaaaagaaaaaagatatgccccacagctttcatgtgcaaaatgattaataatttaactcacctctgcaaagtataaagtgcatacaaatgctatgcaattataacactcattcttaaaacagtattactgttgtttgcaatgctgagctacaaaatatatggttcaaactgaactggcaaagaaatttggaaagaaataatgatggaacatgactcactcactaggcacaacattcacatttcggttgatttgccaatgcagtcattatatagatatattactttgaagaaaacaacttcattagcttatctaagtatgtttcttgagaggaaaaaatctgatatacaaaaccagcaaaaatgtgtacagatagatgatacatcttctgaaagcagatagactattaatttagtgaaaagaatagtttttaatgttttggcaaagtcttttccagcccagagtaaacacaaaatgggcaggctggagtgaaatattttcacagtgtacaaagcagttcacatggatgttgccacagcaaagtaagctgacatgtatttgaggtcatttgcatgagtcaaactttgcaatgagtaactcacccaggaagatataaattatttatagataatgatttgcaaaagaaaatgtctactaaagttgtactagctacattttaaaaaaagtagatttacatggtctgctcattatagacaagtctattcacagtatgcttgactatattatatgtaaaatcatatggcaaaagaaaatgaaataacagagaacatgggaaaatatcccccacatatgttttaaaatgccctgcaattttcacattcaaaattttatgcatctaaatctaaaaaaatattatatagaatactcttaagttacacaaactgataatttactggtttcttttttactctaataggagcaaattaccacatacttgaacaaagttaaaatagttactatttctttataataaatttgatgtataatttacttgtgctttttgcaccaatttataaatacagtatatgcaatacacaaccaagactgacactgacagtaataattaaattcaaaagagcaaatacttaccatacaaaataaacagcaaatacaccttttatgaaaaccagagccttctggactttggggccagattctctggaaaccatgtcaagtgtgagcactggaatctcaagccagctactggatttttttttccccttaaggtggcataaggttcaggagaaccaaaactggcaataaatagttggacgattccactgcagttctttcaggcctttaggatttacatgttgtaccttcacaatgactctcatcaatgatcttgcctcaaaacaaatttgagtacagctacttctaacaggtttccgcac

SEQ ID NO: 142418 - DNA, 524 bp, Homo sapiens
  Payload ID: 8142
  Gene Symbol: IGSF10
  Gene Name: immunoglobulin superfamily, member 10
  ENST ID: ENST00000489791
  CDS Start-End: 1-261
acaatggaagagcgagtgaccagccccaggatagaagctgcatcccagaaaaggactgaagtgaattttggggacaaattactactgaactgctcagccactggggagcccaaaccccaaataatgtggaggttaccatccaaggctgtggtcgaccagcagcataggattctggatttttacttctcagaggcagaagccatgccatgctcctgctgtaaccacaagaccgaatacccagcttactactgtcaggtataactaatcaacatggtataaccacttctccaggaaataccattgtttgctgaattaaacacagacacacacacacacacacaaacaaaaacaaaaatgtatttactgtagttcccagctacttggaaggctgaggtggaaagatcacttgagcctaagagtctgagactgcagtgagccatgatcacattgctgcaccccagcctggctgacaagattgagcctctgtctctaaaataaattaaaattaaaattctgataatgta

SEQ ID NO: 142419 - DNA, 3206 bp, Homo sapiens
  Payload ID: 8143
  Gene Symbol: IGSF11
  Gene Name: immunoglobulin superfamily, member 11
  Uniprot ID: Q5DX21
  ENST ID: ENST00000354673
  CDS Start-End: 30-1322
ttctcaccttcctcaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcat

SEQ ID NO: 142420 - DNA, 3495 bp, Homo sapiens
  Payload ID: 8143
  Gene Symbol: IGSF11
  Gene Name: immunoglobulin superfamily, member 11
  Uniprot ID: Q5DX21
  ENST ID: ENST00000393775
  CDS Start-End: 307-1602
agttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataa

SEQ ID NO: 142421 - DNA, 1952 bp, Homo sapiens
  Payload ID: 8143
  Gene Symbol: IGSF11
  Gene Name: immunoglobulin superfamily, member 11
  Uniprot ID: Q5DX21
  ENST ID: ENST00000441144
  CDS Start-End: 366-1586
aagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcagatgaatggataaagaaaatgcaggacatatggtgggaggagccaagatggccgaataggaacagctccggtctacagctcccagtgtgagcgacacagaagacaggtgatttctgcatttccatctgaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcagcccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagttt

SEQ ID NO: 142422 - DNA, 3525 bp, Homo sapiens
  Payload ID: 8143
  Gene Symbol: IGSF11
  Gene Name: immunoglobulin superfamily, member 11
  Uniprot ID: Q5DX21
  ENST ID: ENST00000425327
  CDS Start-End: 270-1562
gtgcgtcagggagagtggccgtcccgctgttgtaagtggagggacggcagtcagctgaccctgcagtgtgcaggcgagcgcagggagtacgccatgtcctgagaaggggcgattctcaggctctggcagttacagcttctcctcaccctgccgagcaaccaggccacggggctccgtgcatcgccacctagagtgttaccctcttccttgttcacagaggttctccgcagtgtgtgagaaagaggccctctctcaggcaagaagaataaatgtctctggtggaacttttgctctggtggaactgcttttctagaactggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcaccccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataagttgtcattaattatcaatactaacgagtatgtcattttaaaacttagtattctctttaatgttacaaga

SEQ ID NO: 142423 - DNA, 1487 bp, Homo sapiens
  Payload ID: 8143
  Gene Symbol: IGSF11
  Gene Name: immunoglobulin superfamily, member 11
  ENST ID: ENST00000491903
  CDS Start-End: 147-1358
agtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcaggtttgtaccagtgcgtggcttctaatgctattggaaccagcacctgtcttctggatctccaggttatttcacgggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaa

SEQ ID NO: 142424 - DNA, 738 bp, Homo sapiens
  Payload ID: 8143
  Gene Symbol: IGSF11
  Gene Name: immunoglobulin superfamily, member 11
  ENST ID: ENST00000480431
  CDS Start-End: 641-738
ggagaccaagcggggcgagtgggcggcgcggcgaggagccgagctgcggctggagtagcggggcgtgagttggggggagtggctccccggactgcgcgaggggtcggctagtcctggggcagggctgggtggcacggctggcgagcccggaacgcctctggtcacagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtggctaaagcaatcctagtgagacaatggcatgagtaatagtaacagaggagttaagcagttgtgattttctgctccaataatagaatggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggt

SEQ ID NO: 142425 - DNA, 864 bp, Homo sapiens
  Payload ID: 8143
  Gene Symbol: IGSF11
  Gene Name: immunoglobulin superfamily, member 11
  ENST ID: ENST00000483401
  CDS Start-End: 687-864
aggggcagaagaagtgagcctagaaggatggacttgctgaacttctgtttatcctccaagatgtgattagtcttcatagaactccatagaagttcaggaagcaaggagcaatttgactttagcagcagtgtggaggatggattggaagtggaccggaggagatcagttgaggctgtcgtggttgttaaagatcatctctacacatatttgagggccagtgtccttaactgtgtcttgtatatttgagaagccgtatgccataatgtattctggagcacacttcttagatttgaatctcagctagcccacttacacacttagacccagaaagaagagggcagcacacctcagggccagcaggaggaaggggagtcatccaggacatgtactctcaactggcggttgggaagaagacagaaagagatagacatgtgggtcgaagtctttactggggtccgtcgtgttacccaagtggctaaagcaatcctagtgagacaatggcatgagtaatagtaacagaggagttaagcagttgtgattttctgctccaataatagaatggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctacc

SEQ ID NO: 142426 - DNA, 3320 bp, Homo sapiens
  Payload ID: 8143
  Gene Symbol: IGSF11
  Gene Name: immunoglobulin superfamily, member 11
  ENST ID: ENST00000489689
  CDS Start-End: 211-1434
acagctcagcgtccgcggagccgggcggcgctgcagctgcacttggctcgtctgtgggtctgacagtcccagctctgcgcggggaacagcggcccggcgctgggtgtgggaggaccaggctgccccaagagcgcggagactcacgcccgctcctctcctgttgcgaccgggagccgggtaggaggcaggcgcgctccctgcggccccgggatgacttctcagcgttcccctctggcgcctttgctgctcctctctctgcacggtgttgcagcatccctggaagtgtcagagagccctgggagtatccaggtggcccggggtcagccagcagtcctgccctgcactttcactaccagcgctgccctcattaacctcaatgtcatttggatggtcactcctctctccaatgccaaccaacctgaacaggtcatcctgtatcagggtggacagatgtttgatggtgccccccggttccacggtagggtaggatttacaggcaccatgccagctaccaatgtctctatcttcattaataacactcagttatcagacactggcacctaccagtgcctggtcaacaaccttccagacatagggggcaggaacattggggtcaccggtctcacagtgttagttcccccttctgccccacactgccaaatccaaggatcccaggatattggcagcgatgtcatcctgctctgtagctcagaggaaggcattcctcgaccaacttacctttgggagaagttagacaataccctcaaactacctccaacagctactcaggaccaggtccagggaacagtcaccatccggaacatcagtgccctgtcttcagcccagcccaggaacattggactaatagctggagccattggcactggtgcagttattatcattttttgcattgcactaattttaggggcattcttttactggagaagcaaaaataaagaggaggaagaagaagaaattcctaatgaaataagagaggatgatcttccacccaagtgttcttctgccaaagcatttcacactgagatttcctcctcggacaacaacacactaacctcttccaatgcctacaacagtcgatactggagcaacaatccaaaagttcatagaaacacagagtcagtcagccacttcagtgacttgggccaatctttctctttccactcaggcaatgccaacataccatccatttatgctaatgggacccatctggtcccgggtcaacataagactctggtagtgacagccaacagagggtcatcaccacaggtgatgtccaggagcaatggctcagtcagtaggaagcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatat

SEQ ID NO: 142427 - DNA, 3935 bp, Homo sapiens
  Payload ID: 8144
  Gene Symbol: IGSF22
  Gene Name: immunoglobulin superfamily, member 22
  Uniprot ID: Q8N9C0
  ENST ID: ENST00000319338
  CDS Start-End: 191-2902
agggggccagacatttaaggaacagatgacactggtagcctcactgttggggcaaaggaagaaggagacgggccaccctacagtccaggcactagctgagcctccaaagccgtggacacagcattcgagtgttgggagggactggtcagtgctgaagtctcacaggtgagtgcccacgcctgctgtcaccatgacaaccattcacagccggcagatgctgcaggagcacgtgtccatggagttctccagctccaccacccacgtgcagaccttctcccagacaaccaagatcgtgggagaggaggtcgtgaggaggaagtcctcgagcatagtggagttcttcagcttagtgacccggagctcaaacatccctgcgggcgacagcgtccctgagttcgtggagaagcctcaaccggtcaccgcgcccgagggggacaaagccgtgttccgagcccgggtgcaggggaacgccaaaccccacatctcctggaagagggagagcggcatccccatcaaggagtccgccaagatattctacgacagcattaacaaggaacacgtgctgaagctggagccactgacttcggatgactctgacaactataagtgcattgcaagcaatgaccatgcagatgccatctataccgtatctctgctggtaacagaaggtcaagagaaaatggacttcaaaaagatgctgaagaagagggcaccccctgctcccaagaagaagcagaagaaggtggcaaatgagaaagagatgctggagattttgtccaaagtgcccaagaaagactttgagaaggtgtgcatggagtatggtttcaccgactttcgggggctgctcaggaagctcaaagagatgaagaagaaagtagaggtggaggccatccggattctgaagcccctggaagacaaagagaccaaggttgacaccacagtggtctttgactgcataatggaactgaaagaccccaatgtcaagatgatatggatcaagggtactgagccactgaggatccagtactccctgggcaagtacgatgtgaagcagatgggcaccaagtacatgctggttattagcaacgtgaacatgaacgatgctggcatctacagcctgtccgtgggcgataagcggatgagtgcagagctcacagtgctggatgagccactgaagttcctgggagagatgaagcctgtgaaggtgacagagcgccagacagctgtgtttgagatccgcctctccaagaaagagcccaactttgtgtggaagttcaatgggaaggagctgaagagggatgacaagtatgaaatcacggtgtccgaagatggtctgacgcacacgcttaagattaaggatgccagactcagtgacagcggcgagttctctgctgaggcggggaacctggtacaaaaggcccagctcactgttgaccgcatccccatcaagtttgtgagcaacctcaaaaatgtacgtgtgaaagagaggagtcgcgcatgcctggagtgtgagctgacatccaaggatgtgacactgcgctggaagaaggatgggcagctgctgatgcatggcactaagtacagcatgaaccatgagggcaagcgagcagagctgatcattgaggatgcacagctcagtgatggtggcgagtacactgtggtggccatgcaggatggagaccctactgaatactacagtactgccatcgtcactgtggaggagcgtctggccacagtgaagagcgggatgtccgacgtgcacgcggccactgggagcccagctgagttgtgtgtagtgctgaatgacgagaaggtggagggtgtgtggctgaaggatggcaaggagatcacggacttgccaggcatgcagattgtgaagcagggtgcagtgcacaagctcatctttcccagtatgggccctgagcacgagggcaagtacacattccgggccaagggcacggaaagtgaagcctctgtattcatcgcagatcctcctaccatcgacccgtcagtactggaggcactggctgcgcacgccatcactgtgaaggtaggccacacggcccacatcaaggtccccttccggggaaaaccactgcccaaagtgacatggtacaaggatggcatggaagtgacggaggaggaacgcgtgtccatggagcgcggggaagaccaggcactgctcaccatctccaactgtgtgcgtgaagacagcggcctcatcctgctcaagctcaagaatgaccacggctcagccacggccactctgcaccttagtgtgctggagcctcctggttttgcctcccagcctcaagtgactgatgtgactaaagaagccgtgaccatcacgtggaatgcccctacccaggatgggggagccccagtgctcggctacattgtagaacgaaggaagaaaggcagcaacctgtgggtgccagtcaacaaggaccccatccagggcaccaagtgcactgtggatggtctcctggaggacacagaatatgaattccgagttatagctgtaaataaggcaggccctggacagcccagtgtgccatccagctcagtagtggccaaggatcctgttaaacccccaggcctggtccaggacctgcatgtatctgattcctccaactccagcatttccctggcctggcgggagcctgcagagggagacccaccctctggctacatccttgagatgagggctgaagacacaaaggagtggtccaagtgcacaaagatccccatctcaggcacctgctacacagtgggaggactcatcgagaggcagaaatacttcttccgaatccgggctgtgaatgaggctggggttggggagcctgtggagctagacaagggggtccgtgccatgccaccaccagggctcaccaccacctgacgtgatctggcagaaagatggcgttcccaccaagggccgagagacaattaccaagagcaaaaaccactcccagttcctcattaatagcaccaagcgctctgactcaggggtgtaccgaatcttgcttcagaatgagtttggagaagcacgctatgacatccatgtgcgcgtggcagatttccctcggccccccacaaacctacggttgtttgaggaagtccccaacacagtgactctgacctggaaccacagcccagatgtgcaggaggacggtgaggctcactacatcatcatgaagcgggatgcaagcacagccacctggtacacggcagccgagcgtgtcttcagcaacaagtacacagtgacggggctgctcccaggcaggaagtactacttcagagtggtggctcggaatgaaatcggtgacagtgagccacttgactccagggacacctggctcatcaataaggaccagatccaggacctgagcgccaagctcaagccctacgagaagaaggactggcgccacgcgccgcgcttcgtgacgcccctcaagccacacacggtgctccgcggccaggactgcaccatgacctgcgccttccttgggaacccgcggcccacagtgaccctctacaagggcgacgtcaacatcacggccaactccaagttctggtacaactccaccagcggcgtgtgcaccctcgtcatccccacctgcacgctcaaggacagcggcgattacagcgtgctggtggagaacgagctgggcaaggaccgcagcagctgcacgctcaccgtctatgacaaagatgataagtcagttgtagcatccatcaccgagagtctgcagaagaaatcaaagcacctcatgtgagctccagccaagcccaggcatcaggaggctgttatgatgtggagtttcttggcctgtcctctgcatggcccagtgtaggaagcccagtttgctctctggtgtttgttaatgtaaacattcagtgaagggatggggcaataaacgtaactcatcctt

SEQ ID NO: 142428 - DNA, 4284 bp, Homo sapiens
  Payload ID: 8144
  Gene Symbol: IGSF22
  Gene Name: immunoglobulin superfamily, member 22
  Uniprot ID: Q8N9C0
  ENST ID: ENST00000513874
  CDS Start-End: 141-4121
ggcaaaggaagaaggagacgggccaccctacagtccaggcactagctgagcctccaaagccgtggacacagcattcgagtgttgggagggactggtcagtgctgaagtctcacaggtgagtgcccacgcctgctgtcaccatgacaaccattcacagccggcagatgctgcaggagcacgtgtccatggagttctccagctccaccacccacgtgcagaccttctcccagacaaccaagatcgtgggagaggaggtcgtgaggaggaagtcctcgagcatagtggagttcttcagcttagtgacccggagctcaaacatccctgcgggcgacagcgtccctgagttcgtggagaagcctcaaccggtcaccgcgcccgagggggacaaagccgtgttccgagcccgggtgcaggggaacgccaaaccccacatctcctggaagagggagagcggcatccccatcaaggagtccgccaagatattctacgacagcattaacaaggaacacgtgctgaagctggagccactgacttcggatgactctgacaactataagtgcattgcaagcaatgaccatgcagatgccatctataccgtatctctgctggtaacagaaggtcaagagaaaatggacttcaaaaagatgctgaagaagagggcaccccctgctcccaagaagaagcagaagaaggtggcaaatgagaaagagatgctggagattttgtccaaagtgcccaagaaagactttgagaaggtgtgcatggagtatggtttcaccgactttcgggggctgctcaggaagctcaaagagatgaagaagaaagtagaggtggaggccatccggattctgaagcccctggaagacaaagagaccaaggttgacaccacagtggtctttgactgcataatggaactgaaagaccccaatgtcaagatgatatggatcaagggtactgagccactgaggatccagtactccctgggcaagtacgatgtgaagcagatgggcaccaagtacatgctggttattagcaacgtgaacatgaacgatgctggcatctacagcctgtccgtgggcgataagcggatgagtgcagagctcacagtgctggatgagccactgaagttcctgggagagatgaagcctgtgaaggtgacagagcgccagacagctgtgtttgagatccgcctctccaagaaagagcccaactttgtgtggaagttcaatgggaaggagctgaagagggatgacaagtatgaaatcacggtgtccgaagatggtctgacgcacacgcttaagattaaggatgccagactcagtgacagcggcgagttctctgctgaggcggggaacctggtacaaaaggcccagctcactgttgaccgcatccccatcaagtttgtgagcaacctcaaaaatgtacgtgtgaaagagaggagtcgcgcatgcctggagtgtgagctgacatccaaggatgtgacactgcgctggaagaaggatgggcagctgctgatgcatggcactaagtacagcatgaaccatgagggcaagcgagcagagctgatcattgaggatgcacagctcagtgatggtggcgagtacactgtggtggccatgcaggatggagaccctactgaatactacagtactgccatcgtcactgtggaggagcgtctggccacagtgaagagcgggatgtccgacgtgcacgcggccactgggagcccagctgagttgtgtgtagtgctgaatgacgagaaggtggagggtgtgtggctgaaggatggcaaggagatcacggacttgccaggcatgcagattgtgaagcagggtgcagtgcacaagctcatctttcccagtatgggccctgagcacgagggcaagtacacattccgggccaagggcacggaaagtgaagcctctgtattcatcgcagatcctcctaccatcgacccgtcagtactggaggcactggctgcgcacgccatcactgtgaaggtaggccacacggcccacatcaaggtccccttccggggaaaaccactgcccaaagtgacatggtacaaggatggcatggaagtgacggaggaggaacgcgtgtccatggagcgcggggaagaccaggcactgctcaccatctccaactgtgtgcgtgaagacagcggcctcatcctgctcaagctcaagaatgaccacggctcagccacggccactctgcaccttagtgtgctggaccgtccaaagcctccacagggccgggtggagttcctggagctctcaggtagttgtgtgcacatgaagtggaaggccccaaaggacaatggtggacgacctgtgacacagttcatagtggaacggagggcagttggcaagaagtcctggattaagataggcgaggtggacggcaaagtcaccaacttctccaccaacaaggtggaagagggaaaagcctaccagttccgtatcctggcagtcaattcagaaggtgtgagtgacccactggagacagaagaagtgtttgcaggaaatcccatagagcctcctggttttgcctcccagcctcaagtgactgatgtgactaaagaagccgtgaccatcacgtggaatgcccctacccaggatgggggagccccagtgctcggctacattgtagaacgaaggaagaaaggcagcaacctgtgggtgccagtcaacaaggaccccatccagggcaccaagtgcactgtggatggtctcctggaggacacagaatatgaattccgagttatagctgtaaataaggcaggccctggacagcccagtgtgccatccagctcagtagtggccaaggatcctgttaaacccccaggcctggtccaggacctgcatgtatctgattcctccaactccagcatttccctggcctggcgggagcctgcagagggagacccaccctctggctacatccttgagatgagggctgaagacacaaaggagtggtccaagtgcacaaagatccccatctcaggcacctgctacacagtgggaggactcatcgagaggcagaaatacttcttccgaatccgggctgtgaatgaggctggggttggggagcctgtggagctagacaagggggtccgtgccatgccaccaccagctgcacccaagtttgacctcagtgcccggctgaagagtcacatggtggttcgcgctgggacagccctctgcatccatgcagccttctctggctcaccaccacctgacgtgatctggcagaaagatggcgttcccaccaagggccgagagacaattaccaagagcaaaaaccactcccagttcctcattaatagcaccaagcgctctgactcaggggtgtaccgaatcttgcttcagaatgagtttggagaagcacgctatgacatccatgtgcgcgtggcagatttccctcggccccccacaaacctacggttgtttgaggaagtccccaacacagtgactctgacctggaaccacagcccagatgtgcaggaggacggtgaggctcactacatcatcatgaagcgggatgcaagcacagccacctggtacacggcagccgagcgtgtcttcagcaacaagtacacagtgacggggctgctcccaggcaggaagtactacttcagagtggtggctcggaatgaaatcggtgacagtgagccacttgactccagggacacctggctcatcaataaggaccagatccaggacctgagcgccaagctcaagccctacgagaagaaggactggcgccacgcgccgcgcttcgtgacgcccctcaagccacacacggtgctccgcggccaggactgcaccatgacctgcgccttccttgggaacccgcggcccacagtgaccctctacaagggcgacgtcaacatcacggccaactccaagttctggtacaactccaccagcggcgtgtgcaccctcgtcatccccacctgcacgctcaaggacagcggcgattacagcgtgctggtggagaacgagctgggcaaggaccgcagcagctgcacgctcaccgtctatgacaaagatgataagtcagttgtagcatccatcaccgagagtctgcagaagaaatcaaagcacctcatgtgagctccagccaagcccaggcatcaggaggctgttatgatgtggagtttcttggcctgtcctctgcatggcccagtgtaggaagcccagtttgctctctggtgtttgttaatgtaaacattcagtgaagggatggggcaataaacgtaactcatcctttcccgtt

SEQ ID NO: 142429 - DNA, 989 bp, Homo sapiens
  Payload ID: 8145
  Gene Symbol: IGSF23
  Gene Name: immunoglobulin superfamily, member 23
  Uniprot ID: A1L1A6
  ENST ID: ENST00000402988
  CDS Start-End: 17-595
attgtacggtgagagaatgagagcaaaacctcagagcccccttcccaggaaccctgtcccagcctggtccccacccaccaccaccactgacccgatgctagagaaggatgcggctggaggtgacttcccagccaacttggtcctccaactaatgccactgaagacattcccagctgctatccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagctggtctctgagcctgtaaccatctcgctgccaaaacccatcatgcagcccacagaagcagagcccatggagccagaccccactctgtccctgtcaggaggctctgccatcgggctccttgcggctgggatcctgggagccggggcactgattgcaggcatgtgtttcatcatcatccagagcctaaggactgacaggcagagaataggaatatgcagctgaaatgtgggcaactctcctgtcagctgaagagatgggtgctttgtacctctctatccacgtggaaaaaaaaacccatcccatagcttccaagtctacaacatctctgttcaagggaacaacccaacgtaaccagactccctttgccctgtttctgaaacacctgaagaaaacatctgatgggttgactcggtgccatccttggtcccatcgccgtgacacgttgtgcaagcaaagcatcagaggctcatccctgtctgtgggagctcagtgctcagaaaacaggggggaggttttaccttggaaattggccagaccccaaaatatgtcttttacacatgctgctttttttttctctttttcaaaaagaaccaaaaaataaattaaaacaccacca

SEQ ID NO: 142430 - DNA, 473 bp, Homo sapiens
  Payload ID: 8145
  Gene Symbol: IGSF23
  Gene Name: immunoglobulin superfamily, member 23
  ENST ID: ENST00000441389
  CDS Start-End: 1-415
ccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagctggtctctgagcctgtaaccatctcgctgccaaaacccatcatgcagcccacagaagcagagcccatggagccagaccccactctgtccctgtcaggaggctctgccatcgggctccttgcggctgggatcctgggagccggggcactgattgcaggcatgtgtttcatcatcatccagagcctaaggactgacaggcagagaataggaatatgcagctgaaatgtgggcaactctcctgtcagctgaagaggtaataccaggaagggtgtgaaggaaa

SEQ ID NO: 142431 - DNA, 704 bp, Homo sapiens
  Payload ID: 8145
  Gene Symbol: IGSF23
  Gene Name: immunoglobulin superfamily, member 23
  ENST ID: ENST00000428245
  CDS Start-End: 1-637
gaggggtcctctggacgtcagctccagccacacccctacctggaggaagctgcttttaacaggcgccctgctcacatcctgcacctgctctgccttctcagagctgcccttctcggcacagctgaacaccttgaccgaaggagccagtgtccatcttcctgtccccggaaggcttgaagacagcctccaactaatgccactgaagacattcccagctgctatccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagctggtctctgagcctgtaaccatctcgctgccaaaacccatcatgcagcccacagaagcagagcccatggagccagaccccactctgtccctgtcaggaggctctgccatcgggctccttgcggctgggatcctgggagccggggcactgattgcaggcatgtgtttcatcatcatccagagcctaaggactgacaggcagagaataggaatatgcagctgaaatgtgggcaactctcctgtcagctgaagagatgggtgctttgtacctctctatccacgtggaaaaa

SEQ ID NO: 142432 - DNA, 285 bp, Homo sapiens
  Payload ID: 8145
  Gene Symbol: IGSF23
  Gene Name: immunoglobulin superfamily, member 23
  ENST ID: ENST00000592507
  CDS Start-End: 87-285
ggggaagtggccagggtagggcatggtcatcgtgagcagggtcctgcagggtgaggccggggctgcagacgcgactgtacaggtctatgaagaccccatgtgtgatgaggagaccttctctgcacagtccctggacagaacacgagatgaggggtcctctggacgtcagctccagccacacccctacctggaggaagctgcttttaacagacagcctccaactaatgccactgaagacattcccagctgctatccggggagtcatccagagtgagctcaactatt

SEQ ID NO: 142433 - DNA, 3842 bp, Homo sapiens
  Payload ID: 8146
  Gene Symbol: IGSF3
  Gene Name: immunoglobulin superfamily, member 3
  Uniprot ID: O75054
  ENST ID: ENST00000318837
  CDS Start-End: 106-3750
ttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctgggg

SEQ ID NO: 142434 - DNA, 7326 bp, Homo sapiens
  Payload ID: 8146
  Gene Symbol: IGSF3
  Gene Name: immunoglobulin superfamily, member 3
  Uniprot ID: O75054
  ENST ID: ENST00000369483
  CDS Start-End: 769-4413
gcggggactcgggaggggccgcagcgcggctgctggtgccgttgcgggagaagaggaagcggcgcgtcccctgaggcgtgcgcctggatggactgaaggacggtccgacgcgcgcggagggagagggccaggggcgagaaatctgctcgcgctggggtaccgcttcagggctgccgaacgccaacttgcttcgtgtgccctaggcaggcgtggggcaggtggcgcctccgtgacctaccaccatggatggaaacggactttttggtgaagaaacccaaacggttgatgccaggcagggtgatttggccgtcaaaggttttgacgaaacctgccctgttctctctggggaatccgaatgagggagatcacagacaccttcactgagaagccaaggacatttctgtataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaatacggctgttt

SEQ ID NO: 142435 - DNA, 7254 bp, Homo sapiens
  Payload ID: 8146
  Gene Symbol: IGSF3
  Gene Name: immunoglobulin superfamily, member 3
  Uniprot ID: O75054
  ENST ID: ENST00000369486
  CDS Start-End: 767-4351
ggggactcgggaggggccgcagcgcggctgctggtgccgttgcgggagaagaggaagcggcgcgtcccctgaggcgtgcgcctggatggactgaaggacggtccgacgcgcgcggagggagagggccaggggcgagaaatctgctcgcgctggggtaccgcttcagggctgccgaacgccaacttgcttcgtgtgccctaggcaggcgtggggcaggtggcgcctccgtgacctaccaccatggatggaaacggactttttggtgaagaaacccaaacggttgatgccaggcagggtgatttggccgtcaaaggttttgacgaaacctgccctgttctctctggggaatccgaatgagggagatcacagacaccttcactgagaagccaaggacatttctgtataatcagtggatgaaaggattttctcagacccttttttccgtgcttctggaggattaatccactacagtctgcaatttcagtggaaactgcaaggcacacgatgtggcaggagccgggagcgacttccgaattgttgtggacccttcctgtagcataggggagttttcacacttgcctccactcctccccttccccccaactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcaagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaat

SEQ ID NO: 142436 - DNA, 268 bp, Homo sapiens
  Payload ID: 8146
  Gene Symbol: IGSF3
  Gene Name: immunoglobulin superfamily, member 3
  ENST ID: ENST00000481589
  CDS Start-End: 254-268
gagagaagaacctgcattagccgtttaagtgtgcggtgctggcagagtacctccctgaaggtgtcctggggaaagtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttc

SEQ ID NO: 142437 - DNA, 2066 bp, Homo sapiens
  Payload ID: 8147
  Gene Symbol: IGSF5
  Gene Name: immunoglobulin superfamily, member 5
  Uniprot ID: Q9NSI5
  ENST ID: ENST00000380588
  CDS Start-End: 104-1327
accattagtacctaggaggcagggatcagaggaagtagattcagaggtaaggagaattttggggctatactttcaagaaagtcgtgttcgggacccaggaggtatgggtcagaaggaaaggagcacagcagatactctgccggatctggaggaatggaagtcagcggcgggtctgcgatggtggcaaacagcagtggtggacggttctgggtctggtaatgaagtcatagaaggcccccaaaatgcaagagtcctgaagggctcccaggctcgcttcaactgcaccgtctcccagggctggaagctcatcatgtgggctctcagtgacatggtggtgctaagcgtcaggcccatggagcccatcatcaccaatgaccgcttcacctctcagaggtacgaccagggcgggaacttcacctcggagatgatcatccacaatgtggagcccagtgattcggggaacatcagatgcagcctccagaacagtcgcctgcatggatctgcttaccttaccgtccaagttatgggagagctgttcattcccagtgttaatcttgtagtcgctgagaatgaaccttgtgaagttacttgtctaccctcacactggacccggctcccggatatttcctgggagctcggtctcctggtcagccattcaagctattattttgttccggagcccagcgaccttcaaagtgcagtgagcatcctggctctgaccccacagagcaatgggactttgacttgcgtggctacctggaagagcctgaaggcccgcaagtctgcaactgtaaatctcactgtgattcggtgtccccaagacactggaggtggtattaatattccaggtgtattatcaagtttaccgagtttaggtttttcattgcctacttggggcaaagttggacttggactagcaggcaccatgcttctgacgccgacgtgtactcttacaatacgctgctgctgctgccgccgtcgttgttgtggctgcaactgctgctgccgttgttgtttctgctgtagaagaaaaagaggatttcgtattcaatttcaaaagaaatctgaaaaagagaagacaaacaaagaaactgagacagaaagtggaaatgaaaactccggctacaattcagatgaacaaaagaccacagacaccgcttctctccctcccaaatcctgtgaatccagtgatcctgaacaaagaaacagtagctgtggccctcctcaccagcgggctgatcaacgtccacccaggccagcaagtcatccacaggcttcttttaatctggccagtcctgagaaggtcagtaatacaactgtagtatagcaaagccttccccaagctccactgagcacttggctgacaattcaaaacacggcgatggcatccttcctttccatcctaagactggcctgcagctttgccaacattacctgaagaggagatgtcggagtcatcagaactgatacttgacagtgagagaaggaatcgattttcccagagttcaaagtagaatgtgacttttaagaggtttcatggtttttgtgaattccatgaagttactaagtaaaagctgcaaattcatcataatttttctcaacattcaacactcctacttgttaatccaacaaatggtagataaaagtctgtattctaccatgcctttcaaaagtttttattatctgaaagcatatgaagatgatatttatgtatatttaatatgtaggggtattattacatattatcagtgaaatacgagtataaaaattagggtcaaccagaaatctgcaattgactgtcaaaactgagctcagttaaagtaagattcaattctaacatggatgtgcacgttcctaaatatcttatgattgaatatttacatgaaggcattcatttttatctgcccctttatcagacctatttgcatctcctcaaatgaattagatgtggcctatgctttgcagaggatggacctcacctactccgcacaccgtgaaaaaactggaaatgggcattgtagtctttaattaataaaaacaccaaaaatgtgtattgcctttcttaa

SEQ ID NO: 142438 - DNA, 2785 bp, Homo sapiens
  Payload ID: 8148
  Gene Symbol: IGSF6
  Gene Name: immunoglobulin superfamily, member 6
  Uniprot ID: O95976
  ENST ID: ENST00000268389
  CDS Start-End: 63-788
gaaaaaagaaagccaactttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcaaaatccaaccctctaagaaacaaagaaataaaagaagactcacaaaagaagaagagtgctcggcgtatttttcaggaaattgctcaagaactataccataagagacatgtggaaacaaatcagcaatctgagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaataaaggtaaactgaaaagacaactggctacaaagaaggatgtcagaatgtaaggaaactataactaatagtcattaccaaaatactaaaacccaacaaaatgcaactgaaaaataccttccaaatttgccaagaaaaaaaattctattttaaacttgtatcctgagtctgtttcattcaacatgagatgtgtgatgactgccatcctgaagatctgaagccaaaccatgtgcctcagtcttgagtggaagaatcacctttatggtttgtggaaatcatggcacaattaaaataagttgggagggacaacgtgacaaaatttgagttagagacattcattttgaaaagcaccttagtaaagttatttcctctgatgttgtaatggggcagtggggtaacgcacatttgcctgccagggtatgcaaagtaacttacatcatgctatcagcaaaatgagaataatatagtggctagagtaagaccataaaagccaaaatacagaaaatccaaagctgaaggttaaacagaggtaacttcagaacaaataagccacaacggactctagatgtcagtgttgtgccaaataacagcaccagggaagatgtgggcaacacatctactttacaagcacgtttgtaatactgattttttttcttttcttttttttttttttttgagacagagtctcgttctgttgcccagggtggagtgcagtggtgcaatctcggctcactacaacctccacctcccgggttcatgccattcttctgcctcagtttcccaagtagctgggattacaggtacgcaccaccacgcccggctaatttttttttttttttttttttgtatttttagtagagacggggtttcaccatgttggccaggctggtctcaaactcaagacctcagatgatctgcctgaaatggcctcccaaagtgctgggattacaggcgtgagccaccgcgcacagtctataatactgatttttaaccaatttaggagggaaatgtcagataggaggcatggtacaaggatatttatggaattcattaccacttcactaagaaaacatgatataaattgtcctttgaaagctactttggtataaaaaaatctaaagtgcccataagtatgcattcattattagacacaaattacaaccttacaacctactatgtttatttcattaaagtgtctcttttaggccgggtgtggtggctcacgcctgtaatcccaacactttgggaggctgaggcaggtgaatcatgagatcaggagttcgagaccagcctgaacaacatgatgaaacccgtctctactaaaaatacaaaaaaatttagcggggtttggtggcacacacctgtaatcccagctatttgggaggctgaggcaggagatcacttgaacccaggatgcggaggttgcagtgagctgagatcacgccactgcaccccagcctaggtgacagagcaagactgtctcaaaaataaataaataaataaataaataaataaaataaagtgtttcttttaaactggtattgcctaaggtgtattctttataaaacttagaattgttaaatattttaagattcctttgaaagtgtttttgcattgatggtttaaatcagtgatatcaaactttcctgatcctatgtgcccagaaaaatgggcaggggaaaggaggcagcatggaacctcatttttttgtgtgtatctgtgtgtacacgtgagtgcacatgtgtatatgtgtggggccacatgtgttttgtatacggtatatgcatgaaaatgtacctttgtaccttatacacaaaaacaaattaaacaatggcataagcagcaatataaataaaaaatgctaatactttcctgccatattccaaaataaactgtcttgtgtac

SEQ ID NO: 142439 - DNA, 368 bp, Homo sapiens
  Payload ID: 8148
  Gene Symbol: IGSF6
  Gene Name: immunoglobulin superfamily, member 6
  ENST ID: ENST00000569602
  CDS Start-End: 9-368
acacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaaaaattaagctgctcagcaaggaactgcggagcttcctgacagctcttgtatcactgctctctgtctatgtgaccggtgtgtgcgtggccttcatactcctctccaaa

SEQ ID NO: 142440 - DNA, 2343 bp, Homo sapiens
  Payload ID: 8149
  Gene Symbol: IGSF8
  Gene Name: immunoglobulin superfamily, member 8
  Uniprot ID: Q969P0
  ENST ID: ENST00000314485
  CDS Start-End: 218-2059
gccggggcgagaatggtttcagaactgccgagggctggagggaaagcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 142441 - DNA, 2366 bp, Homo sapiens
  Payload ID: 8149
  Gene Symbol: IGSF8
  Gene Name: immunoglobulin superfamily, member 8
  Uniprot ID: Q969P0
  ENST ID: ENST00000368086
  CDS Start-End: 218-2059
gccggggcgagaatggtttcagaactgccgagggctggagggaaagcagcgggaggggcggagggaggggattcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccagcccacaccgggcacccttttcaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagca

SEQ ID NO: 142442 - DNA, 1059 bp, Homo sapiens
  Payload ID: 8149
  Gene Symbol: IGSF8
  Gene Name: immunoglobulin superfamily, member 8
  ENST ID: ENST00000448417
  CDS Start-End: 156-1059
ggaactggggctgggccgaggcccggggcggatccagggctggagtcttggcggggcggggcggggaggggcggggccggggcggggctgggactcgatgcgactcaaagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgt

SEQ ID NO: 142443 - DNA, 2191 bp, Homo sapiens
  Payload ID: 8149
  Gene Symbol: IGSF8
  Gene Name: immunoglobulin superfamily, member 8
  Uniprot ID: Q969P0
  ENST ID: ENST00000614243
  CDS Start-End: 76-1917
tttcgaggggcggggcggggccggggccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgtttt

SEQ ID NO: 142444 - DNA, 3996 bp, Homo sapiens
  Payload ID: 8150
  Gene Symbol: IGSF9
  Gene Name: immunoglobulin superfamily, member 9
  Uniprot ID: Q9P2J2
  ENST ID: ENST00000361509
  CDS Start-End: 199-3690
gtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctgcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatg

SEQ ID NO: 142445 - DNA, 4044 bp, Homo sapiens
  Payload ID: 8150
  Gene Symbol: IGSF9
  Gene Name: immunoglobulin superfamily, member 9
  Uniprot ID: Q9P2J2
  ENST ID: ENST00000368094
  CDS Start-End: 199-3738
gtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatg

SEQ ID NO: 142446 - DNA, 2663 bp, Homo sapiens
  Payload ID: 8150
  Gene Symbol: IGSF9
  Gene Name: immunoglobulin superfamily, member 9
  ENST ID: ENST00000611023
  CDS Start-End: 207-2360
cggcgagagtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaag

SEQ ID NO: 142447 - DNA, 4050 bp, Homo sapiens
  Payload ID: 8151
  Gene Symbol: IGSF9B
  Gene Name: immunoglobulin superfamily, member 9B
  Uniprot ID: Q9UPX0
  ENST ID: ENST00000321016
  CDS Start-End: 1-4050
atgatttggtatgtggccactttcatagcaagtgtgatcggcacccgagggcttgcggctgaaggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacgcccctcccacctttacagaaacacccccccagtacatcgaggccaaggagggtggtagtatcaccatgacctgcacagcttttgggaaccccaagcccattgtcacctggctcaaggaggggacgctcctcggtgctagtgggaaataccaggtgagtgacggcagcctgacagtgacatcggtcagtcgggaggacagaggtgcctacacctgccgagcgtacagcattcagggggaggctgtccacacgactcacctgcttgtccaagggccccctttcatcgtctcccctcctgagaacatcaccgtcaacatctcccaggatgctctgctcacctgccgggcagaggcgtatccgggcaacctcacctacacctggtactggcaggacgagaacgtctactttcagaacgacctgaagctgagggtgcgcatcctaatcgatgggaccctgatcatcttccgggtgaagccggaggactcggggaagtacacctgtgtgcccagcaacagcctggggcgctccccctccgcctcggcgtacctgaccgtgcagtacccagcgcgtgtcctcaacatgccccctgtgatttacgtgcccgtggggatccatggctacatccgctgccctgtggacgcagaaccaccggccaccgtggtcaagtggaacaaggacggccgtcccctgcaggttgagaagaacctcggttggaccctgatggaggatggctccattcgaattgaggaggccacagaggaggctcttggcacttatacctgtgtgccttacaacactctggggaccatgggccagtctgcccctgcgaggcttgtcctgaaggaccccccctatttcacggtgctaccaggctgggagtacaggcaggaggccggccgggagctacttatcccctgtgctgccgcaggggacccctttcctgtcatcacttggagaaaggtagggaagcccagcagaagcaagcacagtgccctgcccagtgggagcctgcagttccgtgccctgagtaaggaggaccacggggagtgggaatgtgtcgccaccaacgtggtcacgagcatcactgccagcacccacctcaccgtcatcggcaccagcccccatgccccgggcagtgtccgggtccaggtctccatgacaactgccaacgtgtcctgggaaccaggctatgatggaggctacgagcagacattctcagtttggatgaagcgggcacagtttgggccccatgactggctgtccttgccagtgccgccaggacccagctggctgctggtggacaccctggagcctgagacagcgtaccagttcagcgtcctggcccagaacaagctgggaaccagcgccttcagtgaggtggtcactgtgaacactttagcattccctattacaactccagaacccctggtgctggtcaccccaccgaggtgcctcatagccaatcggactcagcagggtgtgctcctgtcctggcttccgcctgccaaccacagctttcccatcgaccgctacatcatggagttccgtgtcgcagagcgctgggagttgctcgacgatggcatccccggcaccgaaggagagttctttgccaaggatctgtcacaggacacgtggtatgagttccgggttctggccgtcatgcaggatctgatcagcgagcccagcaacatcgccggcgtctccagcacagacatcttcccgcagccggacctgaccgaggatgggctggcgcggcctgtgctggcgggaatcgtagctaccatctgcttcttggcagctgccatcctgttcagcaccctggctgcctgctttgtcaacaagcagcgcaagcgtaagctcaagcgcaaaaaagaccctccactctccatcacccactgcaggaagagcctggagtctcccttgtcctctggcaaggtgagccccgagagcatccgcacgctccgagcgccgtcagaatcctccgacgaccagggccagcccgcggccaagaggatgctgagccccacccgtgagaaggagctgtcgctgtacaagaagaccaagcgggccatcagcagcaagaagtacagcgtggccaaggcagaggccgaggcagaggccaccacgcccatcgagctcatcagcagaggccctgacggccgcttcgtgatggaccctgccgagatggagccctcgctgaagagcaggcgcatcgagggcttccccttcgccgaggagacggacatgtaccccgagttccgccagtcggacgaggagaacgaggacccactggtgcccacatctgtggccgccctgaagtcccagctcacccctctgtcatccagccaggagtcctacctgccaccaccagcatacagccctcggttccagccccgcgggctggagggccccggtggcctggaaggtcggcttcaggccacaggccaggcccggccccctgccccccggcccttccaccatggccagtattatgggtacctcagcagcagcagccctggggaggtggagccgcccccgttctacgtgccagaagtgggcagccccctgagctccgtcatgtcgtccccgcccctgcccaccgaggggccctttggccaccccaccatccccgaggagaatggagagaatgcatccaacagcacgctgcccttgactcagacacctacaggagggcgctcccctgagccctggggccggccagaattccccttcggggggctggagaccccagcgatgatgttcccccaccagctgccaccctgtgatgtgcccgagagtctgcagcccaaggccggcctcccccgaggactgccccccacctccctgcaggtgcccgcggcctacccgggcatcctgtctctggaggcaccgaagggttgggcaggcaagtcgcccggcaggggccctgtcccagcgccccccgccgccaagtggcaggacagacctatgcaacctctggtaagccaagggcagctgcgacatacaagccaaggcatgggcatacctgtgctgccttaccccgagccggctgagccgggggcgcacggcggccccagcacatttggcctggacacccggtggtatgagccccagccccggccccggcctagccctcggcaggccaggcgcgccgagcccagtttacatcaagtggtgctacagccctcccggctctcacctctgacccaaagccccctcagctcccgcaccggctcccctgagctcgccgcccgtgcccggcctcgcccgggcctcctgcagcaggcagagatgtcagagatcaccctgcagccgccggctgcagtcagcttttctcgaaagtctacgccgtccacaggctccccctcccagagcagccgcagtgggagtcccagctaccggcccgccatgggcttcaccactctggccaccggctacccttcccctccacccggccccgcccctgctgggcctggggacagcttggacgtgtttggacagacgccttcccctcgaaggacgggggaggaattgctccgaccggagaccccaccacccacgttacctacttcagggaagctgcagagagacagaccagctcccgcgaccagcccgcctgagagagcactctctaaactgtag

SEQ ID NO: 142448 - DNA, 618 bp, Homo sapiens
  Payload ID: 8151
  Gene Symbol: IGSF9B
  Gene Name: immunoglobulin superfamily, member 9B
  ENST ID: ENST00000533160
  CDS Start-End: 1-618
tcctttctgtgtccaacctggccgtccccatcaggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacgcccctcccacctttacagaaacacccccccagtacatcgaggccaaggagggtggtagtatcaccatgacctgcacagcttttgggaaccccaagcccattgtcacctggctcaaggaggggacgctcctcggtgctagtgggaaataccaggtgagtgacggcagcctgacagtgacatcggtcagtcgggaggacagaggtgcctacacctgccgagcgtacagcattcagggggag

SEQ ID NO: 142449 - DNA, 565 bp, Homo sapiens
  Payload ID: 8151
  Gene Symbol: IGSF9B
  Gene Name: immunoglobulin superfamily, member 9B
  ENST ID: ENST00000526663
  CDS Start-End: 80-565
agtctgctggaggcagctgacctatttttcttgggaatcttcctgcttttctgttctctcttgcgtgaataagcaggagatggggcctccaagagggctctggagaaagagtccgagtgcgccagagctgggaggagtctcagccggcctgactgtcctttctgagaaggtcccgctcagcctggctttctgtcctctgtggccccttgcctccctcctggtcgtgtgtgcccccgagatggagcgggggcctgtgacttgcacacaggcacagactgtacgaggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggccgggccagtcttcatgataaggcatctctgcggctggaacaagttcgctctgaggaccagggctggtatgagtgcaaagtg

SEQ ID NO: 142450 - DNA, 5050 bp, Homo sapiens
  Payload ID: 8151
  Gene Symbol: IGSF9B
  Gene Name: immunoglobulin superfamily, member 9B
  Uniprot ID: Q9UPX0
  ENST ID: ENST00000533871
  CDS Start-End: 232-4545
gctccgcccgggcgagtagtgcaggtgccgctgcgccggggccggggaggcgcgcgccgagccgagcggagcctaggagggatggagagctggccacccgggctgcaggagcaccggcgcggggcgtaggcggcgcgaggcgggcgcgaggcgggcgctcgggcgcgaggcgcgtgcgggcgcgggagcactttgcgataggatgaggctccgggctggcgcggtagtactatgatttggtatgtggccactttcatagcaagtgtgatcggcacccgagggcttgcggctgaaggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacgcccctcccacctttacagaaacacccccccagtacatcgaggccaaggagggtggtagtatcaccatgacctgcacagcttttgggaaccccaagcccattgtcacctggctcaaggaggggacgctcctcggtgctagtgggaaataccaggtgagtgacggcagcctgacagtgacatcggtcagtcgggaggacagaggtgcctacacctgccgagcgtacagcattcagggggaggctgtccacacgactcacctgcttgtccaagggccccctttcatcgtctcccctcctgagaacatcaccgtcaacatctcccaggatgctctgctcacctgccgggcagaggcgtatccgggcaacctcacctacacctggtactggcaggacgagaacgtctactttcagaacgacctgaagctgagggtgcgcatcctaatcgatgggaccctgatcatcttccgggtgaagccggaggactcggggaagtacacctgtgtgcccagcaacagcctggggcgctccccctccgcctcggcgtacctgaccgtgcagtacccagcgcgtgtcctcaacatgccccctgtgatttacgtgcccgtggggatccatggctacatccgctgccctgtggacgcagaaccaccggccaccgtggtcaagtggaacaaggacggccgtcccctgcaggttgagaagaacctcggttggaccctgatggaggatggctccattcgaattgaggaggccacagaggaggctcttggcacttatacctgtgtgccttacaacactctggggaccatgggccagtctgcccctgcgaggcttgtcctgaaggaccccccctatttcacggtgctaccaggctgggagtacaggcaggaggccggccgggagctacttatcccctgtgctgccgcaggggacccctttcctgtcatcacttggagaaaggtagggaagcccagcagaagcaagcacagtgccctgcccagtgggagcctgcagttccgtgccctgagtaaggaggaccacggggagtgggaatgtgtcgccaccaacgtggtcacgagcatcactgccagcacccacctcaccgtcatcggcaccagcccccatgccccgggcagtgtccgggtccaggtctccatgacaactgccaacgtgtcctgggaaccaggctatgatggaggctacgagcagacattctcagtttggatgaagcgggcacagtttgggccccatgactggctgtccttgccagtgccgccaggacccagctggctgctggtggacaccctggagcctgagacagcgtaccagttcagcgtcctggcccagaacaagctgggaaccagcgccttcagtgaggtggtcactgtgaacactttagcattccctattacaactccagaacccctggtgctggtcaccccaccgaggtgcctcatagccaatcggactcagcagggtgtgctcctgtcctggcttccgcctgccaaccacagctttcccatcgaccgctacatcatggagttccgtgtcgcagagcgctgggagttgctcgacgatggcatccccggcaccgaaggagagttctttgccaaggatctgtcacaggacacgtggtatgagttccgggttctggccgtcatgcaggatctgatcagcgagcccagcaacatcgccggcgtctccagcacagacatcttcccgcagccggacctgaccgaggatgggctggcgcggcctgtgctggcgggaatcgtagctaccatctgcttcttggcagctgccatcctgttcagcaccctggctgcctgctttgtcaacaagcagcgcaagcgtaagctcaagcgcaaaaaagaccctccactctccatcacccactgcaggaagagcctggagtctcccttgtcctctggcaaggtgagccccgagagcatccgcacgctccgagcgccgtcagaatcctccgacgaccagggccagcccgcggccaagaggatgctgagccccacccgtgagaaggagctgtcgctgtacaagaagaccaagcgggccatcagcagcaagaagtacagcgtggccaaggcagaggccgaggcagaggccaccacgcccatcgagctcatcagcagaggccctgacggccgcttcgtgatggaccctgccgagatggagccctcgctgaagagcaggcgcatcgagggcttccccttcgccgaggagacggacatgtaccccgagttccgccagtcggacgaggagaacgaggacccactggtgcccacatctgtggccgccctgaagtcccagctcacccctctgtcatccagccaggagtcctacctgccaccaccagcatacagccctcggttccagccccgcgggctggagggccccggtggcctggaaggtcggcttcaggccacaggccaggcccggccccctgccccccggcccttccaccatggccagtattatgggtacctcagcagcagcagccctggggaggtggagccgcccccgttctacgtgccagaagtgggcagccccctgagctccgtcatgtcgtccccgcccctgcccaccgaggggccctttggccaccccaccatccccgaggagaatggagagaatgcatccaacagcacgctgcccttgactcagacacctacaggagggcgctcccctgagccctggggccggccagaattccccttcggggggctggagaccccagcgatgatgttcccccaccagctgccaccctgtgatgtgcccgagagtctgcagcccaaggccggcctcccccgaggactgccccccacctccctgcaggtgcccgcggcctacccgggcatcctgtctctggaggcaccgaagggttgggcaggcaagtcgcccggcaggggccctgtcccagcgccccccgccgccaagtggcaggacagacctatgcaacctctggtaagccaagggcagctgcgacatacaagccaaggcatgggcatacctgtgctgccttaccccgagccggctgagccgggggcgcacggcggccccagcacatttggcctggacacccggtggtatgagccccagccccggccccggcctagccctcggcaggccaggcgcgccgagcccagtttacatcaagtggtgctacagccctcccggctctcacctctgacccaaagccccctcagctcccgcaccggctcccctgagctcgccgcccgtgcccggcctcgcccgggcctcctgcagcaggcagagatgtcagagatcaccctgcagccgccggctgcagtcagcttttctcgaaagtctacgccgtccacaggctccccctcccagagcagccgcagtgggagtcccagctaccggcccgccatgggcttcaccactctggccaccggctacccttcccctccacccggccccgcccctgctgggcctggggacagcttggacgtgtttggacagacgccttcccctcgaaggacgggggaggaattgctccgaccggagaccccaccacccacgttacctacttcaggaacacttccacctgcacccgggaacgctgctgcgcctgagaggctggaggctctgaaataccaacggataaagaagcccaaaaagtcatccaagggctcttcgaagtcaaagaaacgatccgacgattctgcctcccagactcagcagcttcccaactctcaggttctgtggcccgatgaagctgtctgcctccgaaagaagaagagacattctcgtcctgacccctttgcccggctctcagacttgtgccaccgccagcttccggaagaccagacagcgattctcaacagtgtggaccacgatgacccaggacatgccactttgctgtgactccaccccactctaggtgtccccggggcgaggttgctgggctcaggcagggagggccactgtgtgggggtgtgtcctcctccgtctgccaagggcggcccagacctttgtcctgcatgccccctcttttgccagagcgggtgtctccctccagatcctggccgcctgtcttcaggacggagggtgggcacaccttccacctgtgggtcgaggtcaggaagtggattggagactgggcaacacctgtctcctcccctccgccccctgcttcactaggttgatttttctcatctcttccaatgtctttggaagtgaagaggaaagcaatggcttttactgctctctgcttctgtttcagtttttcaagtcctggaagaaggctggacttaatgtccatcttccacaccccacatatatatagatatagatacagatgcatatgtctgtagtgtgtgggtttctctatgtgtgtatatatatatatatatatgtacattgaggcaaa

SEQ ID NO: 142451 - DNA, 4439 bp, Homo sapiens
  Payload ID: 8152
  Gene Symbol: IGFN1
  Gene Name: immunoglobulin-like and fibronectin type III domain containing 1
  Uniprot ID: Q86VF2
  ENST ID: ENST00000295591
  CDS Start-End: 131-3886
gtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagagggccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatggcacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaccttcagtccacaagtgctgaccacaaactgcagagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcatagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgctgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggaccctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatccacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggaccctcaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaatacaggca

SEQ ID NO: 142452 - DNA, 11810 bp, Homo sapiens
  Payload ID: 8152
  Gene Symbol: IGFN1
  Gene Name: immunoglobulin-like and fibronectin type III domain containing 1
  Uniprot ID: Q86VF2
  ENST ID: ENST00000335211
  CDS Start-End: 131-11257
gtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagagggccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatggcacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaccttcagtccacaagtgctgaccacaaactgcagaggcaaggagcccaggcatcaggagcagaagagtctgggagcatcgagagccagggagagaaatccagagagcagggccccagggggggctcccttgaaggggctgggccggcttctgggctccagcacatagccagcccagacagggatggccttggcagacatggctactccttgatgggggacaaagggacagctgactcagcctggggccctggacaggagggcgagggctttccagtagcagagggaagcagagccactcttcccagggaaaatcaatcccacagagagggaggctgggccagaagccttgcagagaggccccatctacagggagagagctcagaatcagggttgggcctcccagaaaaacaacagcaagatcgtggcagagacagcaacagtgatgaatgctggaggaaagcaggaggctgggaggctgggtccagtcggcttcaggctggaggactggggagcagcagggaaggaaaggagcacagaggggacagtggaagacaactggacaggcatgccccagagcaactgtgggatgctcgactgggacctgggagaggaaagagcgacctgcagggatgccagtctgatcctgtagggtcctggccaagaggaaagcagatagagatttcacaggatgacagcctggctgagatggacagaggggatgctccaagtagggaaagggggagaggaatagtagtgtggggtggtgggactggcctgggagaagctggagacagcaatggggcaggaggtcctggcaccctggagcttactggaggaagaggttctggctccaaggtgggcatggcccctgaatcctggggttctcagggaggtagagatgctgactatggggaagccaggggctactgggggtcaggagagttgctagaacagatacctggaggcaaggacttccaggaaccatcaatatcaggtggtagaaaattccttctgggagatgggagtcctgagatcaaagctgaagactcactgcaggaggcagatggtatatgccggggggagtctgtagttacaggaagtgcctacaaaactggccctggaggcccaggagaccccagaggctgcgaaggtgtcctacaggagctcaggggaagggatggccaggaaacagcttgggcctcgggtgaggtagagtatgaccccagaagcttccagtcttcccagggctggacagcaggtcacagagcagcagggggtattggcagaatagaatctaagggcacaagtccttgggatgacacaccatctagcctcagaaaaactggggcccaccatgggcctggagtgctggggcccagtggaggacaagagggtatgggtggtatctgggtggctggactgacggagtctggtcagggggtggatgccagaagccactggctaagtagggctccaggcctgggtgctcagggatctggggggacactaggagataagaaaggattaagaggtcctgggtcaatagggtctgaaccagatttctggaatgggtcagggagctccagagtaaaaggacccagaggtgagacaggctataaggatggcttggaaggtcccgggagaatggaatctaggtacgagggtggcttaggatattctagggaaataagctctaaaagcggggctggttatagctatggctcaggggttccaggagaaatggggtccggccatggtgctggttgtagagtttcccctagggcacctgcgggagtggagtctgaggaagggggtgggtacaggcatggctccggagcgcctgggggagtgtggtctggaaatgaagattctggccctgcaggaggagggtctgggagagttgccagtcttaaaaatggctcaggtggtcctgatggagcacccatgaatgacaccaggaattgggcctctgcatgccaggcaggcatggaccctaggggagggcaccattcagatggtggcctagggagtcctggggtgacagggtctgcgggtagaggtggtctcaaggcccctggagtagtggagactgttgggatgggatgtgtggaagcagaaccagagagctctggaagaataaggccttggggtcagactggaaattatgggggcttcagagcctcagaggccctgggggcctttggagaaggaggctatgaagatggctctgggggtccaggagccatgggaccagggtctctgagggcaggaagcaaagtgggtgagggggatgggacaagatgccctggtgctaaggcctctggagctggagctggttatagggatgataccaggcaccctgagtcactcgcacctcacaatggggccgcttctgggagccagtgggcttatggggctggcaatgtgctgggttatgaggatggatcagaacttccagggcctcagggaactggggtcagaacagcctatggagaaaggtcaaggggccttgggcctaggagtacagggccagggggtgaggcaggctttagagatggttcaggaggcctccaaggaatgggatcagcagatgggccaggttgtaggaagggtattgggagttctggggaaatggggtcagtggataaggaaggttataagaaagatttgggggctcctgagaatatgggttcggggagcaaggcagattatagggatggtgtagggggttctggggcaatggggtcaatggatgaagcaggttataggaaagatttaggggctcctgagggaataagttcagggagcaaggcagattataggggtggtttacaggattccagggaagcgggttcagggagcaaggcagattatagcggtggtttaaagggttccagggaaatcgggtcaatggatgaaacagataataggaaagatttgggggttcctgagggaatgggtgcaggttacagggctggtttaaggggtcctggggagatggggtcactggatgagtcaggtcataggaatgggattggaggttatggggaaatggggtcaggttatagggaggatttgggggctcctgagggaatgggcacagggagcaaggcaggttatagggatggcttaaggggttctggagaaatgaggtcaatggatgaggcaggttataggaaaaatttgggagctcctgagagaatggattcagggagcaaggcaggttacaggggtggtttaaggggttctggggaaatggggttaattgaggcaggctataggaaagatttgggggtttctgagggagggggttcagggagcaaagcaggttataggggtggcttaggttctggggaaatggggtctgtggataaggcaggctataggaaggatttgggggcttctgaggcaataggttcagggagtaaggcaggttttacggatggtttaggaggttctgaagaaatggggtcagtgaataaggcaggttataggaaggatttgggggctcctaagggaatgggttcagggagtaaggcaagttttagggatggtttaggaggttctggagaaatggggtcagtgaatgaagcaggttataggaaggacttgggggttcctgagggaataggttcaggaagtaaggcaggttttagggatggtttagggggttctgaagaaatggggtcagtgaataaggcaggttataggaaggatttgggggctcctaagggaataggttcagggagcaaggcaggttttagggatggtttagggagttctggggaaatggggtcaatggatgaggcaggttataggaagaatttgggggctcctgagggaataggttcagggagtaaggcaggttttagggatggtttagggagttctgtagaaatggggtcagtgaatgaggcaggttataggaaggatttgggggctcctgagggaatgggttcagggagtaaggcaggtttcagggatggtttagggggttctggagaaatggggtcagtgaatgaagcaggttataggaaggatttgggtgctcctaagggaataggttcagggagcaaggcagattttagggatgctttagggagttctggggaaatggggtcaatggatgaggcaggttataggaaggatttgtgggctcctgagggaataggttcaggaagtaaggcaggttttagggatggtttagggagttctgtagaaatggggtcagtgaatgaggcaggttataggaaggatttgggggctcctgagggaatgggttcagggagtaaggcaggtttcagggatggtttagggggttctggagaaatggggtcagtgaatgaagcaggttataggaaggatttgggtgctcctaagggaataggttcagggagcaaggcagattttagggatgctttagggagttctggggaaatggggtcaatggatgaggcaggttataggaaggatttgtgggctcctgagggaataggttcaggaagtaaggcaggttttagggatggtttagggagttctgtagaaatggggtcagtgaatgaggcaggttataggaaggatttgggggctcctgagggaatgggttcagggagtaaggaaggtttcagggatggtttagggggttctgaagaaatggggtcagtgaataaggcaggttataggaaggatttgggggctcctaagggaatgggttcagggagtaaggaaggtttcagggatggtttagggggttctgaggaaatggggtcaatggatgaggcaggttataggaaggatttgggggctcctgagggaataggttcagggagtaaggcaggtttcagggatggtttagggggttctgaagaaatgcggtcaatggatgaggcaggttataggaaggatttgggggctcctgagagaataggttcaggaagtaaggcaggttttagggatggtttagggagttctgtagaaatggggtcagtgaatgaggcaggttataggaaggatttaggggctcctaagggaatgggttcagggagtaagacaggtttcagggatggtttagggggttctgaagaaatggagtcaatggatgaggcaggttataggaaggatttgggggctcctgagggaataggttcaggaagtaaggcaggttttagggatggtttagggagttctacagaaatggggtcagtgaatgaggcaggttataggaaggatttgggggctcctaagggaatgggttcagagagtaaggcaggttttagggatggtttagggagttctggggaaatggggtcaatggatgaggcaggttataggaaggatttgggagctcctgagggaatgggttcagggagtaaggcaggtttcagggatggtttagggggttctgaagaaatggggtcagtgaataaggcaggttataggaaggatttgggggctcctaagggaatgggttcagggagtaaggcaggtttcagggatggtttagggagttctggggaaatggggtcaatggatgaggcagattataggaaggatttgggagctcctgaggaaatgggttcaggcagttacacagattacaggaatggtttaggcagttctggaaaaatcagttcaggggatgaggcaggttataagaatgttttagggggttctgggaggaatccattagggagcgaggcaggttctaggggtagtttggaggattctgggtacattttgtcatggaatgaggcaggttctaggcaaggctttgggggaactagtggcatggggtcagggagtgaggtcagttatagaggaggctcaggaggatctggggaaacgggaccagagggtaagatgggttatggagatggttcagggaggcttggagtaccaggctcactggctggaataggacatgaggctggacccagaggccataaagccatgggtcacaggtcaggatattgggtagcatcagagggtgacacgaactccaaggatggtccagagcgagccagggaaaccaggcttgtggatggggcaggacctggggtggaacctgggatggctggaatgccaggcactgcaggtggcatggcacacagagacagcctcaggggcacaggggtgctggggtctcagggagggcgacagactctttcagatgagcgaggctccaccaaagatcttgggggctatggaacttcagggatccctgaggcctcggaggctgctggtgccaagggaaaaccagatgtcaaagaatggcaagacagttctgggactccagggtcttctagagacagaggggctcccagggtgaaggataggtctccagaccaagcagggataatgggggcttctgggtttcttgatggcaagggggcagtggaaggtgagacctgggcaggaatggctgctctagggtctggatatgaacgggacatctggaaagcaggcccaggaatgacagacaggggtagagttgctggccagggggggttggcatctcagggaggtggggactcacttttgggaggcagaagggtaggctcagggagttcagtggggacaggtcaggatctggacagcggctctatgcctgggggaaggggcaagtcaacatcagggcctgctgatagacaagggacgagcaatgcttgggctcctgattgggaaaaccaggggtttagccaaggcagcatagatgctgggaagcagcccgcaggctccagagcttccggttctctgcaggagaaagatgccgcttttggtgggacccatgaagggccagggggctttaagggtggggagggtgcaccaggccaagaggcggctggtggatgccgaagcccatggtccctggatagcaaaggttcaagtcctggaaggggcagttctgttgatgcagaggactcaggtatcctgggcaaggggaattctactgagtgggggaatgccctcaccccaaaacctggggagtccggacctcagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcatagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgctgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggaccctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatccacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggaccctcaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaatacaggca

SEQ ID NO: 142453 - DNA, 3932 bp, Homo sapiens
  Payload ID: 8152
  Gene Symbol: IGFN1
  Gene Name: immunoglobulin-like and fibronectin type III domain containing 1
  ENST ID: ENST00000412892
  CDS Start-End: 1-3379
aggcagaagggtaggctcagggagttcagtggggacaggtcaggatctggacagcggctctatgcctgggggaaggggcaagtcaacatcagggcctgctgatagacaagggacgagcaatgcttgggctcctgattgggaaaaccaggggtttagccaaggcagcatagatgctgggaagcagcccgcaggctccagagcttccggttctctgcaggagaaagatgccgcttttggtgggacccatgaagggccagggggctttaagggtggggagggtgcaccaggccaagaggcggctggtggatgccgaagcccatggtccctggatagcaaaggttcaagtcctggaaggggcagttctgttgatgcagaggactcaggtatcctgggcaaggggaattctactgagtgggggaatgccctcaccccaaaacctggggagtccggacctcagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcatagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgctgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggaccctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatccacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggaccctcaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaatacaggca

SEQ ID NO: 142454 - DNA, 4085 bp, Homo sapiens
  Payload ID: 8152
  Gene Symbol: IGFN1
  Gene Name: immunoglobulin-like and fibronectin type III domain containing 1
  Uniprot ID: Q86VF2
  ENST ID: ENST00000437879
  CDS Start-End: 131-1843
gtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagagggccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatggcacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaccttcagtccacaagtgctgaccacaaactgcagagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccgatccagacctaccactaactctgctcagactgcttaggaagaagcagttgagatgaacacagtgctgggctcctgctgggggggaggagccggttatgcttctctgaccccaatacactgggccctcaggaagttgctgggtaggatggtggtccccagccctgagtggtgccagcaagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgctgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggaccctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatccacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctgga

SEQ ID NO: 142455 - DNA, 2659 bp, Homo sapiens
  Payload ID: 8153
  Gene Symbol: ILDR1
  Gene Name: immunoglobulin-like domain containing receptor 1
  Uniprot ID: Q86SU0
  ENST ID: ENST00000273691
  CDS Start-End: 107-1615
ccgaggggttccttggagaaggtggtgcgtcctggggcggcagctgaggaagaaagacgcagtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcgtgataaatgaagtgatgtggtgggaccatggagtgtattactgcaccattgaggctccaggggacacatcaggagaccccgataaggaagtaaagctcatcgtcctacactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcggctcctgtgtgtcatcagcatcacctaggtttccagctgacttgggaactgcaagtctgagtctaacagtttttggcttagattctgagaatcaaatagaagaattttaaatacaagagtttgagattgggtatagtggctcacacctgtaatcacagcactttgggaggctaagaatcacttgagactaggagttcaagatcagcctgggaaacatagtgagaccccgtctctacaaaaaatataaaaattagttaggtgtggtggcatgcacttgtagtcccagctactcaagaggctgaggcagaaggatcccttgagcccaggagtgcaaggctgcaatgagccaggatcccatgatcacacatctgtattccagcctgggcaatagagcaagtccccattactaaaaaacccaaaaggccaaaaaacaaaaaagttagagttcgaggaattaccaactgtagttttagccttggttcatgctctcttgcatatttatataatctctgacttgtaatggaccctgactggaatgtgatccctcaggaacttagtagcctgagtctttcagtagactacactgcccagaaccctggccattctcaaaatgagaacttgggaatgtttaagaagaaatcaaacatgtttcaggaaaaggaaatctatggagtattatagggacattcccatgggaatgtatcttcctccatggcatgtcttgagggtcctttcttgttaggagtttatcctgccagcccataaatggactatttattgtaagtgtagaaaatcacagagaagcagttttgcaccagccttattcctgtgccttgttttcctcttgctctttttttacctgtatatctaatttatattttcatatatattgtgtattgattgaagtcactttaaatccttcttgggaatgacacagtatataaataaggaagaaagaaaacatgccaagctgagcatgctgctccaaataaatatctgctttccta

SEQ ID NO: 142456 - DNA, 2226 bp, Homo sapiens
  Payload ID: 8153
  Gene Symbol: ILDR1
  Gene Name: immunoglobulin-like domain containing receptor 1
  Uniprot ID: Q86SU0
  ENST ID: ENST00000344209
  CDS Start-End: 128-1768
ctgcgccgagggaggggaaacccgaggggttccttggagaaggtggtgcgtcctggggcggcagctgaggaagaaagacgcagtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcgtgataaatgaagtgatgtggtgggaccatggagtgtattactgcaccattgaggctccaggggacacatcaggagaccccgataaggaagtaaagctcatcgtcctacactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaagccctggcccgccaccgctacatgaagcaggcccaggccctaggtcctcagatgatgggaaaacccctgtactggggggcggacaggagctcccaggtttcatcttatccaatgcacccgctgctgcagcgagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcggctcctgtgtgtcatcagcatcacctaggtttccagctgacttgggaactgcaagtctgagtctaacagtttttggcttagattctgagaatcaaatagaagaattttaaatacaagagtttgagattgggtatagtggctcacacctgtaatcacagcactttgggaggctaagaatcacttgagactaggagttcaagatcagcctgggaaacatagtgagaccccgtctctacaaaaaatataaaaattagttaggtgtggtggcatgcacttgtagtcccagctactcaagaggctgaggcagaaggatcccttgagcccaggagtgcaaggctgcaatgagccaggatcccatgatcacacatctgtattccagcctgggcaatagagcaagtccccattactaaaaaacccaaaa

SEQ ID NO: 142457 - DNA, 1456 bp, Homo sapiens
  Payload ID: 8153
  Gene Symbol: ILDR1
  Gene Name: immunoglobulin-like domain containing receptor 1
  Uniprot ID: Q86SU0
  ENST ID: ENST00000393631
  CDS Start-End: 46-1419
gtgccccgaagcccctgagctgaaaagggccagaaagggggcggcatggcatggcccaaactgcccgcaccttggctgctgctctgcacctggctcccagcagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccccctggcccgccaccgctacatgaagcaggcccaggccctaggtcctcagatgatgggaaaacccctgtactggggggcggacaggagctcccaggtttcatcttatccaatgcacccgctgctgcagcgagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcg

SEQ ID NO: 142458 - DNA, 1612 bp, Homo sapiens
  Payload ID: 8153
  Gene Symbol: ILDR1
  Gene Name: immunoglobulin-like domain containing receptor 1
  Uniprot ID: Q86SU0
  ENST ID: ENST00000462014
  CDS Start-End: 47-1591
taagaacccagactctgtctgtgagctcctagccaggtcaggcaggatggcaggcaatatcttttgcccatttgcattgtttttcttacccatgagcagagtaggtcaccttcagcattttctcctgctcttggctttagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgagcagatctcgtgataaatgaagtgatgtggtgggaccatggagtgtattactgcaccattgaggctccaggggacacatcaggagaccccgataaggaagtaaagctcatcgtcctacactggctgacagtgatcttcatcatcctgggagccctcctcctcctgctgctgattggagtgtgctggtgccagtgctgtcctcagtattgctgctgctatatccgctgtccctgctgtcctgcccactgctgctgtcctgaggaagatttgtccctgccgtccagcctcccgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaactt

SEQ ID NO: 142459 - DNA, 13140 bp, Homo sapiens
  Payload ID: 8154
  Gene Symbol: ILDR2
  Gene Name: immunoglobulin-like domain containing receptor 2
  Uniprot ID: Q71H61
  ENST ID: ENST00000271417
  CDS Start-End: 57-1976
gttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatccccatcactttacagtcactagtcaatgactgttgttacactaaaatcaaaaggcctttggtgagctcagtgacagtgacctctgggacaatcacagaaatgacttcactgctgttctgaatgacaattcttaagtggctaggacaaagcaaaagcgagtatacctttttgaaaagctgtctaagtggtatttccttttccattctgagaacgtaaactgctttttccttttctgctgcacatgtcaatatcggagtcttagacattaagggctcttctcttcctcccctctcctggacttcccacaggttggtgccacacacacagccctgcctccctctgcactctgattagattgtcattgaatgccttgtgataaatgcttaaaatatacacatgaaagagaagagggaggaaagaggagaaagcagtaatgcatatagaaaagaatgagaaggaatttaaaagggaaataacatcatctcattatattttgaatgtggaccatttcacccacaaacttcactcagtcttttccggttttgtgcttcacttgccgttaattgtttctgccatcccagttctgccattctaggacatgggggatgtggaacatacagcatttggcctgactagactgccactatggctgctttcaagagattagagatactgctttctcaggaaggagtacttcctattcccacccttgcctaaatgatagattttgcctaaatcccaaagctagatctctggattttatcgtttgtgtagatagcaaaaatggccacgaactctttccttctcatcaagaggtgccatcttttttccaaccccttgaatctggagttggctatgtgatttgatttagccagtagcccaacaaatgtgacacaagcagagacttgaaaagttcttgtgcatggggcttgtcctcttttgctgctcttgggaaccttgcaactaccatcaggtgaacaagcctggactatcctgctgcatgacaaaagaaaagggcccagttacccttgtcaccctatctgacagcccgtcaacttccagctgatgcagacatgggtgagtccaggtgataccaatagaagaactgcctagctgaacccagcccaaatttctgattcctactcgaggcgtgagaagttggtgcattctttatgttcatttctctttaagaacaaacctgactcgttcttgtctgaatgttcatccctgaacctcttaatccatccaaacttgtgtttctcatagcctccactattgttgacaaatttttatcaaagcttttcaccctgcactcttgtggagtggaggataatgcttgactttgctatcccttaatccagcagtggtttcttccctgtctatggatccgtggacaacctctgaagatctcttctttaccatccttttggtcttctccagagccaccctactggggctagaccctattctcaaagtaccattcctctagtatccatttgtacttcatgacatttccaaaaaaagtcctatgtttgcaatgaaataagaaagtggctgggtgagggtcggagggatgagctggtatgtgtcattgcttggagaattgacctaccaaaggacttccgtgttgctttggccagtcccagagaaatcaggagaacagttgaacccagtgctggcacttccaagggctggaagacacaagccataaccctggtgctgagttttagacttgctggtgtccctggcctctgaaagcctaggtctagcctgtctgtttggaccccagttcagatggaaaagatgataaaaaacatttcttagtcaccagctttggatttcaacttgctcaggcaattttggagaatattgggtagctgtggtagctattatcgctttatactgagcactgtgtcaggcttttcaccaccaaagagcctcatagcaccagctgcagagaccaaaaataatgtttttttaaagctacggacgtatgattttggtgaaggttgagggtagcaatgggaaagaaagaattattaaaattggaaacctgcaattccaaagacaacaaaactacagatagactgaaaagtacaaagaagatagcaggctactgaattaaccttgggagttgggaccaggttgtcctttgtagaactggataaatcattcagacttccaggctttcagtagagagaaaaagcagttgtttctgggtatatggacaggagttaaggctgagttgacaagtcaaaacttcttgtcctcagcacccctgactttcctctatgtgtccttttgtttcttctcctttgaatagtgtgtcctgcacaggaaatggttatatttgttagcttctttcctaggtcttattggagtacaaagtaaatcttgtgtaagacataatctctgtccactaggaccccgtaatttaataggggaaataagacatgctcaagaaaggagattttatacatagagtatgaaatagtgctatggataaattataataaaaccagagatttagtttttttaaaaaatgagaatactttgatattaaagtgttgtatgtgtttgtccatcatcttatttaaacatagacttggtgatctgaaaagccaatactcaaaagtctgaactgaaaagaggtgaattaggatcgggaaagggtgagcagcaggggtcccagggggatgatgcataagctgctgtgcttgcctgtgagtcactactgagtcaggaacacgctggaggagggagtgtggatgcaggtggcagggaggtgtcccctggtagatgagctgcttctctaggccatgcatggattcattaggaagttggagacaatggccatggacctggtgcatggcagctattccatccaagcacgttcacaggggagctcagcgtggctgctcctggggctcagttctgcggctgtgagtgctgctgcccatattcaccaacacagggcaggcctcacggagatgctaggcctcacatcccccttctcatgatcctcactgtgcacttgacataggattaggcatactggagatgagaaaaggctgccacccaaacccaaggcacctgaccacatctgtaaatatttctgaatagtccacaaaatttcacataggtagtctgattagatcttgcctttgagagaagctgaagtcacagatactgttgtaatttaccaccgcccctcacccaattttttttaataggtgaagaaaccatcactgccattaatgaagtcacaaacctattaggtctttagactcccaacctctggatcttttctgctgattagtgtttcccaaaattgcctaaccacaagaattaacttgatagctgctgttaaaaaggtattgttggaccctgttttggagattgattgggtgggtctagagccagaattcatatttttaatatgcattccaggagactcctgtgatcagatgcatttggaaatcattgcactaagtcatacctctgggtactccaaacagctagtcctgaggcttccttgggccttagaattttttcttcaaatgtcctggtgaggtccctctcaatcctttggggctggctgtggtgagtcactcagaagtctggctgtgacctggatgggctcaccagagtacgctagtggtagtgggaaaacaggcagagagaaaggagtgtcaggagcactcccagggaggctgttgtagatatttccattcccagaacagtgatctattgtgacagtctcagaacagacaacaagaattacaggtaattttctcattctcttgatatatttttagcaaaacttaaatcatgaatagaaggaaaagatgccattggggaaatagaaaaactcaatcattttataaagcatacaaatcataaggatgactggccaatagcactcccactttggtcttacctaaagttgggtggacaagaataataaaagtcctcattttatatccttccaaaatcagatttaaatgctgccagcatcttaatggaagtctgaaattgattgataggatgtagaaatccaaattcactaaaatagggggccagctacataaagtcctagaaggaaaaagtgcctcgcttttttctgccattatcctaccccctagtcatctggggaattgatctatgaagcttgaagaaggggcatttaacatcagagtggtgcaagggcagtgttgagatgctttaagcagcagcctgagctttagcactatttgaaggggagaaggttaatactaataatatttgtgttatttttatgatatattactgtttacagaacactttcatttgatcccaacatcaactgctgtgatagaggcagggcagatgttgtggtctcattacatagaatgtaaaactgaggttgaaaaatactaagtgacttgtctgtagtcaaatggtttttaaaattataaagccaggccttctgactgtcttgtctggtgtcctttccaattccttaaatactcatgggactggaatctgggtattccagattccagtttctcttcacagccagacatctggtgagaagagccgtagacttgatgcttgttcatatgtcatggatgtggcgaagccatgaagacagatactgttgctgcttcatccaactaagcaccattcattcctcaaatgctaatctaagagggagttgtagcttcactcaaggagagtttcgttttctttttctttcttttttttttttttgagacagggtcttgctctgtggcccatggtgcagtgcagtgcagtggtgctatcagctcactgcagtctcaaactcctagctcaagcaatcctcctccctcagcctcccaagtaggtaggactacagatatatgccaccacgtccagcaaattttgtttgtttgtagagatggggtcttgctatatttcccaggcttgtctcaaactcctggcctcaagtgatcctcccaccttggctgcctaaagtgctggtattacagacatgagccactgaacccagctgagagcctcactttcatcacctgtgctgtgaggggtaatatatgcttcaggttttctggagaatccttcttgcagagaagtttctgaatgaaacgacagattcatctggattcagaactccaggcagaagctgcttaacagcaaaaatctggcatcttcactacattttaagattttaggtagaactaagagggatcagatatagaggaataaggaatgtgagaaggaaaaagatatagtagtttagctaaatttttcttagagtttcttggtggggctggccatgaagtaactagtctgactcatttcttctgggaaggctaaaagagacacagatagcttctcttttaccttggctttaaggaaaagccattttattaacaaaagtattagacacgactgcataagaaatttgctgtgtgagaataaagaacaagggagtaggagggtgggacagagaagggtgagaagttggcttcgtgagggccacctgtcagttgtctttgtgccttgtgacatcaaaactgaaatgtttgtattactgttgtccatgactttttttttctgtgtcagacatacaaattgaatttggttgtaatgttttaaacgtaataaagaattcttacctacatttgttaccaagaactcataattaacacaactatggttaatcatgatctgacattaaatggcctcagcaagagaaagaatcatatgatacatgtccttctctgattgttgtaagtacagtaatagaggaatacatattgtggggttacagagggggctggtactgacagagcaaaaggtatgcttttacagattgtaataagctagataaattctgttgtcactcttactgctctccacagactgtaacattcagaaggagatgaagggtaggaaaggtggttggataaggtgatggtacctagctcatttccaagaggggcacaagcatatgcctgctagaaattacacttggggaagggaggaaggaagctattcgtgggaggacatttcaagttctgttaagatttgagaaattccacagcaccataattaagaggaggcaattaaaaacctttgttagcaaaagaagtgataaatacctctgagaactattaatcctgttttggatggctaagccctctcaagggaattccagattttagtggccttgtcaagcagaaaatctgtttttgcttgaagcatctgggctcaattttttttaagtagttaacttaaaaatgttaacatgtagatttaacttaaagatagactctaaaacagtttgattacctctggattttgtattattttgtgttttaattccatttaggtttttcagctttataaaatatttttgtttttatttataaagtatttgtttagaatcacccacgtgttttttctacacatctttttttcctatatttcagatcttccttttgaaatattttctttctgaaggaagtttacttcagtaatgatttgttggtaggatactcatcagtctttgttgatgtaaaagtctttatttcattcttgttcttgaaagataatttcactgattatgattctagattgatagttattttctttcaggacattgaagttattattacactcccttctgacttttatttttgcttttaagaagtcaattaccagtttaattatccttcctaatctgtctggtctctctgactgttctaaagatttttttgtctctagtgttctttggtttaattaacatgtgaccaggtgtggatttctttttatttatccaaattaggatttgtggtgtttcctaaatccgtggattggatttcccattaaatatggaaaactctcagctatattaacacatcaaatatttcctcttctttttaaactctctcttgagaattccaattgttagattttttttcattctatgccccatattgtttaatctatattttgtatttcctctctctgtgttttctattccctattcaggtaaatttcttcaggtttatcttccagctcactaattttcttttcagctagctctaatctcctttatttgagttttaattttaattaatatgtatttcatttctaggagtttagttctttttcaaatttacatagtccctgttgtcttgtgacttactctttttttttttttacaatgccctcttatttatctgaatatcttaaagatactaacttaaaattttatatccagtaattccaatatctacagtctttgtgggtctacttttagagtttgttacttctgctaactttcactcacagttttttgtttctttatgggttttatagttttttattttaagctcatgtgtggtgcaatgccatattacattgtgccagtcaagaaaaacctttcttgctccttatctgccttacatttctccataatgactctatatatacacagcaaccctggggaagccaggaagagtgaatgattgagtaaggaagaagtaagtgtgctaaatgggaaaaaatgaaaaaggcacacatacacgcattgtgcatttctttctaatgcaacctgtagactgcaaacaaaatcttaagatggggagggcaagaggctttaactttacatattctttagagtttgataatataagagaatggctgtcttaattatagacatagactgttttagggtttaagagtgaacagaaggctgttaattgttaagagtggccaaataaattatggatgtagatttcattcaagaggcaaggaaggccgggccctgtggctcacacctgaaatcccaacagttagggagacaaaggtgggaggatagcttgagccaggagttcaagacctacctgggcagtatagtgagatcccatcctccacaaaaaggtaaaaatttaaaaagacaagaaaaaaaagaagcagcaaggaaggactagactcataggatggattaaaattaggcaaaacaaataattcatttttccctatgattatctaattctaatccaatttttatatgctttcatttcaagaaataagaagtaggctaatttcaggttctcttagaaaatcttggcagagacatcctaatcatactcatcacaccacttaggtgaaaattatattttctgctgaattggttataagcatttcctgaatacttatcaggtggcctaagatgactcaccaaaaatggcatgaggtgtagaagtagctaggaagttgcttagaggtgagtgagttggtctgacacgccatctagtggcacacatccaagagagtgactctattgctaaccttccagtattggatggaggtgtgcctcacattacttaagggaaaagctacatatgaatttatatagcttattttaatgctatatatgaatttatatagatgaatttggcttttgaaaaacaaattaagtgcattaggaattttttctttaaaagtgatatgtttttcttacactttgcaagtttagaacttgccatattatgtttttgaggcaggcttctgtggatataatgtggggaaaaccatgaggtttttgcttgggatcaagtgggatttaggtgcatgccttttgtgatttaaagctattttaaagtgtgcttttaacaccatggaattacaattgttttctgaagtcaggtcaggactctgattctgcagaattatggtgaagccagtttctctttaacaagcaaaaaccgtgtcatcaaactgtacaaccaaaggacctaaatagtccattccctagtcttcagctgtacaaagatgaatcaatctctctgtctcttgttctctctctcactgtctctaaaaaccaagcagaggagaaaattccagacatgttaaaacactttacttttttttaaaacaatccttgctctctggagatattttctcacattttgttacaaattttgtgtagaagcatagccacagtggattttttctggctctttttctttctctgagacgttaatgtccagtagagcaaagctagaaggatatatatatatatatatatatataaatatatatatttatatatatttatatatatatatatatatatatgtatgtatacacacacacatatatatgtcaatttctattaaccttgtttttggaaaaacgctttgttcaactgaatgtagttaaattataatggacattaatatacaaccccaccctcccagcctctttttgttgctggtatgacttaggcacctagcttttctcattccctcaggccaaggcgatagcctcttatgtttcattcctttggcagctgtattagtaaaaaaatttttggttgcaaatgacaggaagatagctcagactagcttaagaacaagaaaaggagaaatggagctcatctattagagagatcctggagtagctcacaggctggaagagctgtaggaactgagaacaaacctgggtctcaatgtagtaagatttaagattccctgtccatcatccacacctacttgtgtttttacatcaatacattttctcagtgaggatagacttactccaaaaggcaggaatatagccactagcagtctgagagtcacaactttccagctcatttgaccaagcaggcaaaaggctttactcatgagaacaatcctggagaaagactgcagtcaactcatattgagtcatgtgcccatatctgagctaatcatgtggccagagatgtggcaagtctgtttatgaccaggaaggtgagactgcgatggactggatagtgggataggaagatttctccaaagagagaagagagttgttattaatagaagaagtgagaatagtgatgctgggcagacaaaacacatacacaacaccaacagctatctgctactgcatccgaaaagattctttatctgcagccacagagccctgaacaaccagcctttccggcttccttttgttgccaattccctcacacgtattattccaacccaaggcttcagggaggctgtttttaccacagttcagtgacaaatcctaccagagccttccatataccagtgaatgtccttggttatacttgtctcgttctgaatttagaaatccatctctgtgtcactgccttcattaggacctttcgtctcctccctggattcttctggtaccctcatttcttgtctcctacttcctgttgtctcctaattattcaccttctactttttttgttagaggttccagacagtttcaagaaaaatacttaatgctgggcaaggtgcttctcccttcctctctaagttccatagaacaggggacattttgcttctctgttgctatggactgagtgttttgtgtcttccccaaatttttatgtcaaaatcctaatcctaatgtgatggtatttgggcatgaggcctttgggaggtgattaggtcagtagggtggagctcttatgatggaattagtgtccttataagaagagacaggagagagattacttcctctctttctctgccatgtgaggatacagcaaggtatctgtctgcaaaccaggaaaaggaccttcgccaggaactgaatgtattggtgcactgagcttggacttcccagattctagaactgtgagaaataaatttctgatatttaa

SEQ ID NO: 142460 - DNA, 1238 bp, Homo sapiens
  Payload ID: 8154
  Gene Symbol: ILDR2
  Gene Name: immunoglobulin-like domain containing receptor 2
  ENST ID: ENST00000529387
  CDS Start-End: 215-718
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttggaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 142461 - DNA, 2446 bp, Homo sapiens
  Payload ID: 8154
  Gene Symbol: ILDR2
  Gene Name: immunoglobulin-like domain containing receptor 2
  ENST ID: ENST00000528703
  CDS Start-End: 215-1957
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagcctttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 142462 - DNA, 2299 bp, Homo sapiens
  Payload ID: 8154
  Gene Symbol: ILDR2
  Gene Name: immunoglobulin-like domain containing receptor 2
  ENST ID: ENST00000526687
  CDS Start-End: 215-1810
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 142463 - DNA, 2242 bp, Homo sapiens
  Payload ID: 8154
  Gene Symbol: ILDR2
  Gene Name: immunoglobulin-like domain containing receptor 2
  ENST ID: ENST00000525740
  CDS Start-End: 215-1753
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttggttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 142464 - DNA, 2566 bp, Homo sapiens
  Payload ID: 8154
  Gene Symbol: ILDR2
  Gene Name: immunoglobulin-like domain containing receptor 2
  ENST ID: ENST00000529071
  CDS Start-End: 215-2077
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttggagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagccagccgcgctccaagtcggagatgctgtcgcggaagaacttcgccacgggggtgccggccgtttccatggacgagctggcggccttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 142465 - DNA, 1950 bp, Homo sapiens
  Payload ID: 8154
  Gene Symbol: ILDR2
  Gene Name: immunoglobulin-like domain containing receptor 2
  ENST ID: ENST00000469934
  CDS Start-End: 215-1528
cggaccccggaagcccgcggcagcgcgcgctcagccggcggcgcgatccagcccccggccccgcctgcgcggccggcccggcgggcgctgcgcccagggacgcccggtgcccgccgctccgccgccgcccgctgccgcggggtgacagcgatccttctgttccagccatttcccactttcctcactccgtaattcggctgggaagttggggaagatggatagggtcttgctgaggtggatttctctcttctggctaacagccatggtcgaaggccttcaggtcacagtgcccgacaagaagaaggtggccatgctcttccagcccactgtgcttcgctgccacttctcaacatcctcccatcagcctgcagttgtgcagtggaagttcaagtcctactgccaggatcgcatgggagaatccttgggcatgtcctctacccgggcccaatctctcagcaagagaaacctggaatgggacccctacttggattgtttggacagcaggaggactgttcgagtagtagcttcaaaacagggctcgactgtcaccctgggagatttctacaggggcagagagatcacgattgttcatgatgcagatcttcaaattggaaagcttatgtggggagacagcggactctattactgtattatcaccaccccagatgacctggaggggaaaaatgaggactcagtggaactgctggtgttgggcaggacagggctgcttgctgatctcttgcccagttttgctgtggagattatgccagagtgggtgtttgttggcctggtgctcctgggcgtcttcctcttcttcgtcctggtggggatctgctggtgccagtgctgccctcacagctgctgctgctatgtccgctgcccatgctgcccagattcctgctgctgccctcaagccttgtatgaagcagggaaagcagcaaaggccgggtaccctccctctgtctccggtgtccccggcccttactccatcccctctgtccctttgggaggagccccctcatctggcatgctgatggacaagccgcatccacctcccttggcaccaagtgactccactggaggaagccacagtgttcgcaaaggttaccggatccaggctgacaaagagagagactccatgaaggtcctgtactatgttgagaaggagctggctcagtttgatccagccagaaggatgagaggcagatataacaacaccatctcagaactcagctccctacatgaggaggacagcaatttccgccagtctttccatcagatgagaagcaagcagttccctgtgtctggggacttggagagcaatcctgactattggtcaggtgtcatgggaggcagcagtggggcaagccgcgggccctcagccatggagtataacaaagaggatcgagagagcttcaggcacagaatgactttccaaccaggatgtcccttgtggtctgatgttgtcaacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatcccc

SEQ ID NO: 142466 - DNA, 2165 bp, Homo sapiens
  Payload ID: 8155
  Gene Symbol: IRG1
  Gene Name: immunoresponsive 1 homolog (mouse)
  Uniprot ID: A6NK06
  ENST ID: ENST00000377462
  CDS Start-End: 63-1508
ccagcaaacaaattactcctctggttcactcctcctgaactgaacctcttctttacaacgaaatgatgctcaagtctatcacagaaagctttgccacagcaatccatggcttgaaagtgggacacctgacagatcgtgttattcagaggagcaagaggatgattctagacactctgggtgctgggttcctgggaaccactacggaagtgtttcacatagccagccaatatagcaagatctacagttccaacatatccagcactgtttggggtcagccagacatcaggctcccgcccacatatgctgcttttgtgaacggtgtggctattcactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccaatgacatgccaaagagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtagcagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagacctagaagactgttctgtgttaactacacttctcaaaggaccctctccaccagaggtagcttcaaactctccagcatgtaataattctatcacaaatctctcctgaggcttaccaacatctaaatgactttgcatttggggagattcaatgatttggtttgtaaagcaagggtctgctgcttggttttcccaggaaaaatgaacaaagatggagagagtccagaaacagaactacatatatctggaaggagccttctcctgaaaattttgcaggacagttccacttacctaaatcaagatgaaacacacacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcattttggctctagaacccatggtcttaagcactgcaatatatcacctttcagtataaaaatatttgaatcagagttgcaataaa

SEQ ID NO: 142467 - DNA, 2097 bp, Homo sapiens
  Payload ID: 8155
  Gene Symbol: IRG1
  Gene Name: immunoresponsive 1 homolog (mouse)
  ENST ID: ENST00000449753
  CDS Start-End: 1-1446
ttccctttaaagtctatcacagaaagctttgccacagcaatccatggcttgaaagtgggacacctgacagatcgtgttattcagaggagcaagaggatgattctagacactctgggtgctgggttcctgggaaccactacggaagtgtttcacatagccagccaatatagcaagatctacagttccaacatatccagcactgtttggggtcagccagacatcaggctcccgcccacatatgctgcttttgtgaacggtgtggctattcactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccaatgacatgccaaagagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtagcagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagacctagaagactgttctgtgttaactacacttctcaaaggaccctctccaccagaggtagcttcaaactctccagcatgtaataattctatcacaaatctctcctgaggcttaccaacatctaaatgactttgcatttggggagattcaatgatttggtttgtaaagcaagggtctgctgcttggttttcccaggaaaaatgaacaaagatggagagagtccagaaacagaactacatatatctggaaggagccttctcctgaaaattttgcaggacagttccacttacctaaatcaagatgaaacacacacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcattttggctctagaacccatggtcttaagcactgcaatatatcacctttcagtataaaaatatttgaatcagagttgc

SEQ ID NO: 142468 - DNA, 2479 bp, Homo sapiens
  Payload ID: 8156
  Gene Symbol: IMPDH1
  Gene Name: IMP (inosine 5'-monophosphate) dehydrogenase 1
  Uniprot ID: P20839
  ENST ID: ENST00000348127
  CDS Start-End: 82-1773
actcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatc

SEQ ID NO: 142469 - DNA, 2881 bp, Homo sapiens
  Payload ID: 8156
  Gene Symbol: IMPDH1
  Gene Name: IMP (inosine 5'-monophosphate) dehydrogenase 1
  Uniprot ID: P20839
  ENST ID: ENST00000338791
  CDS Start-End: 352-2151
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccagggcggagcccagtcgactcccggattcccctgccccgcccccggcacgaggccccgccccggcggccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccacta

SEQ ID NO: 142470 - DNA, 2580 bp, Homo sapiens
  Payload ID: 8156
  Gene Symbol: IMPDH1
  Gene Name: IMP (inosine 5'-monophosphate) dehydrogenase 1
  Uniprot ID: P20839
  ENST ID: ENST00000354269
  CDS Start-End: 82-1851
actcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagctgtttcctcctagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccact

SEQ ID NO: 142471 - DNA, 2431 bp, Homo sapiens
  Payload ID: 8156
  Gene Symbol: IMPDH1
  Gene Name: IMP (inosine 5'-monophosphate) dehydrogenase 1
  Uniprot ID: P20839
  ENST ID: ENST00000419067
  CDS Start-End: 1-1701
atggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagcgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccacta

SEQ ID NO: 142472 - DNA, 1888 bp, Homo sapiens
  Payload ID: 8156
  Gene Symbol: IMPDH1
  Gene Name: IMP (inosine 5'-monophosphate) dehydrogenase 1
  ENST ID: ENST00000470772
  CDS Start-End: 79-1620
agtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctca

SEQ ID NO: 142473 - DNA, 598 bp, Homo sapiens
  Payload ID: 8156
  Gene Symbol: IMPDH1
  Gene Name: IMP (inosine 5'-monophosphate) dehydrogenase 1
  ENST ID: ENST00000489263
  CDS Start-End: 47-598
cccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcgacttcctgattctcccaggattcatagacttcatagctgatgaggtggacctgacctcagccctgacccggaagatcacgctgaagacgccactgatctcctcccccatggacactgtgacagaggctgacatggccattgccatggctaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacg

SEQ ID NO: 142474 - DNA, 2422 bp, Homo sapiens
  Payload ID: 8156
  Gene Symbol: IMPDH1
  Gene Name: IMP (inosine 5'-monophosphate) dehydrogenase 1
  ENST ID: ENST00000484496
  CDS Start-End: 1-681
agccctagattggacctcgctacacacccgacgacaccccgttcagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggcaaatgttcctggccccacaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcctatacctttctgccgtttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccacta

SEQ ID NO: 142475 - DNA, 952 bp, Homo sapiens
  Payload ID: 8156
  Gene Symbol: IMPDH1
  Gene Name: IMP (inosine 5'-monophosphate) dehydrogenase 1
  ENST ID: ENST00000497868
  CDS Start-End: 86-952
cgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttg

SEQ ID NO: 142476 - DNA, 1765 bp, Homo sapiens
  Payload ID: 8156
  Gene Symbol: IMPDH1
  Gene Name: IMP (inosine 5'-monophosphate) dehydrogenase 1
  Uniprot ID: P20839
  ENST ID: ENST00000480861
  CDS Start-End: 79-1608
agtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctg

SEQ ID NO: 142477 - DNA, 590 bp, Homo sapiens
  Payload ID: 8156
  Gene Symbol: IMPDH1
  Gene Name: IMP (inosine 5'-monophosphate) dehydrogenase 1
  ENST ID: ENST00000473463
  CDS Start-End: 82-291
actcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttcc

SEQ ID NO: 142478 - DNA, 2295 bp, Homo sapiens
  Payload ID: 8156
  Gene Symbol: IMPDH1
  Gene Name: IMP (inosine 5'-monophosphate) dehydrogenase 1
  ENST ID: ENST00000469328
  CDS Start-End: 1-571
catggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggcaaatgttcctggccccacaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccacta

SEQ ID NO: 142479 - DNA, 2283 bp, Homo sapiens
  Payload ID: 8156
  Gene Symbol: IMPDH1
  Gene Name: IMP (inosine 5'-monophosphate) dehydrogenase 1
  Uniprot ID: P20839
  ENST ID: ENST00000496200
  CDS Start-End: 85-1554
gtcagcagtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccact

SEQ ID NO: 142480 - DNA, 2862 bp, Homo sapiens
  Payload ID: 8156
  Gene Symbol: IMPDH1
  Gene Name: IMP (inosine 5'-monophosphate) dehydrogenase 1
  ENST ID: ENST00000626419
  CDS Start-End: 607-2148
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccagggcggagcccagtcgactcccggattcccctgccccgcccccggcacgaggccccgccccggcggccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggt

SEQ ID NO: 142481 - DNA, 1643 bp, Homo sapiens
  Payload ID: 8157
  Gene Symbol: IMPDH2
  Gene Name: IMP (inosine 5'-monophosphate) dehydrogenase 2
  Uniprot ID: P12268
  ENST ID: ENST00000326739
  CDS Start-End: 41-1585
cgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaa

SEQ ID NO: 142482 - DNA, 1469 bp, Homo sapiens
  Payload ID: 8157
  Gene Symbol: IMPDH2
  Gene Name: IMP (inosine 5'-monophosphate) dehydrogenase 2
  ENST ID: ENST00000429182
  CDS Start-End: 1-1411
catggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtggctcccaagatccctccagacataaagtcccacagccccaaatgcccttctactgtcacgggttgctatatgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaa

SEQ ID NO: 142483 - DNA, 865 bp, Homo sapiens
  Payload ID: 8157
  Gene Symbol: IMPDH2
  Gene Name: IMP (inosine 5'-monophosphate) dehydrogenase 2
  ENST ID: ENST00000442157
  CDS Start-End: 29-865
agacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatggt

SEQ ID NO: 142484 - DNA, 2028 bp, Homo sapiens
  Payload ID: 8158
  Gene Symbol: IMP3
  Gene Name: IMP3, U3 small nucleolar ribonucleoprotein
  Uniprot ID: Q9NV31
  ENST ID: ENST00000314852
  CDS Start-End: 945-1499
aaaatagaagagactcactctgaaaccaccattccagaaacccgggcagggctcggctgtccctctggctcccagattcttttggcggctctcgctttgggaggctctcacattcctctgcagatctgccccttcctccttcctcctcttgctcctgggccactgggttttcaaaaatccggaaaatccaagaggggcaaggagaaaagcagcagccgcctgaatcgagtccaagggtggatgtgtccggcttcacaacgagccaggccgggaaaacaaggactgaggcttacacaacaggccgccaactcttcgaccccggctgcgcagccggagcccccgccggctcgggcgccctctccccgccccagaagtggccagccccaaccccggaggaaggagggggcgcgacgaggctgtcgggcgacttctagccactcgctgagtggtctcttttgtttgcctaattcctcagcagtttctgagcctgacgctgaccctgctctgaatcccaggaaccccgtccaaaggtaaccccagcagaaaccggttcctcacccgggacttacgacccccgatcaccaccctcgcgtgcacgcacacactcaacagtttggagtttggagagtgagctccggcgagcagatggcgcggccagccgtctgtccgtccgtcctcctctccgccctgcggggcccggccagtggggggcgggctgcgcccccagcctgccttccccggcgctcgcagaccctccgctccgccagcgagaaggcagctccaaaacaaaaaggcgattccgggaggtggcgtcctgaggaaggaggggatcgccaaaggggagggtcccaggccgtccaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaactttttaa

SEQ ID NO: 142485 - DNA, 1237 bp, Homo sapiens
  Payload ID: 8158
  Gene Symbol: IMP3
  Gene Name: IMP3, U3 small nucleolar ribonucleoprotein
  Uniprot ID: Q9NV31
  ENST ID: ENST00000403490
  CDS Start-End: 156-710
ccctggccaatgggaagtgagggcgtgactttaagtctttctttcattggcccagggtcccaggccgtccaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccagggaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaacttttt

SEQ ID NO: 142486 - DNA, 1740 bp, Homo sapiens
  Payload ID: 8159
  Gene Symbol: IMP4
  Gene Name: IMP4, U3 small nucleolar ribonucleoprotein
  Uniprot ID: Q96G21
  ENST ID: ENST00000259239
  CDS Start-End: 709-1584
cccatctggggatccccacgccggcagcaccaaggcctctgggtcagcttctttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 142487 - DNA, 958 bp, Homo sapiens
  Payload ID: 8159
  Gene Symbol: IMP4
  Gene Name: IMP4, U3 small nucleolar ribonucleoprotein
  ENST ID: ENST00000409935
  CDS Start-End: 57-803
gtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgagtgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctg

SEQ ID NO: 142488 - DNA, 822 bp, Homo sapiens
  Payload ID: 8159
  Gene Symbol: IMP4
  Gene Name: IMP4, U3 small nucleolar ribonucleoprotein
  ENST ID: ENST00000409649
  CDS Start-End: 306-822
cccacgtggaagcggcactcaagatggtaggagaatgagctcctgtttcggagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatga

SEQ ID NO: 142489 - DNA, 924 bp, Homo sapiens
  Payload ID: 8159
  Gene Symbol: IMP4
  Gene Name: IMP4, U3 small nucleolar ribonucleoprotein
  ENST ID: ENST00000428740
  CDS Start-End: 215-924
gcactcaagatggtaggagaatgagctcctgtttcggagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtaactatacaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtg

SEQ ID NO: 142490 - DNA, 923 bp, Homo sapiens
  Payload ID: 8159
  Gene Symbol: IMP4
  Gene Name: IMP4, U3 small nucleolar ribonucleoprotein
  ENST ID: ENST00000452955
  CDS Start-End: 1-842
tttccaaatgcttgccggccgttttccttgcccattgggttctcctgttggttttgagagtgtttcttccgtgtgatgaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtc

SEQ ID NO: 142491 - DNA, 460 bp, Homo sapiens
  Payload ID: 8159
  Gene Symbol: IMP4
  Gene Name: IMP4, U3 small nucleolar ribonucleoprotein
  ENST ID: ENST00000456713
  CDS Start-End: 22-252
cacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtaactatacaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcat

SEQ ID NO: 142492 - DNA, 3792 bp, Homo sapiens
  Payload ID: 8160
  Gene Symbol: IMPACT
  Gene Name: impact RWD domain protein
  Uniprot ID: Q9P2X3
  ENST ID: ENST00000284202
  CDS Start-End: 142-1104
agatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcgcttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggcttaaatgtc

SEQ ID NO: 142493 - DNA, 603 bp, Homo sapiens
  Payload ID: 8160
  Gene Symbol: IMPACT
  Gene Name: impact RWD domain protein
  ENST ID: ENST00000585067
  CDS Start-End: 64-603
cccgcccccgcgctccggacctggcaggcggcggctgcagggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcgcttaaagcattggattttgatatcagtgaaactcggacagaagtagaagtagaagaattacctccgattgatcatggcattcctattacagaccgaagaagtacttttcaggcacacttggctccagtggtttgtcccaaacag

SEQ ID NO: 142494 - DNA, 520 bp, Homo sapiens
  Payload ID: 8160
  Gene Symbol: IMPACT
  Gene Name: impact RWD domain protein
  ENST ID: ENST00000580035
  CDS Start-End: 1-55
ggctttgggaaagaacaaaaaagtaagaaaagacaagaagaggaatgaacattaatacctgaaactataggaaagtgttcatcattgagtaatggattaagtgaaaatccaggagtatccatctgcagttatgtgctgagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggctta

SEQ ID NO: 142495 - DNA, 598 bp, Homo sapiens
  Payload ID: 8160
  Gene Symbol: IMPACT
  Gene Name: impact RWD domain protein
  ENST ID: ENST00000581278
  CDS Start-End: 1-321
gatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaaatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggcttaaa

SEQ ID NO: 142496 - DNA, 570 bp, Homo sapiens
  Payload ID: 8160
  Gene Symbol: IMPACT
  Gene Name: impact RWD domain protein
  ENST ID: ENST00000578221
  CDS Start-End: 16-570
aggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcgcttaaagcattggattttgatatcagtgaaactcggacagaagtagaagaattacctccgattgatcatggcattcctattacagaccgaagaagtacttttcag

SEQ ID NO: 142497 - DNA, 4356 bp, Homo sapiens
  Payload ID: 8161
  Gene Symbol: IPO11
  Gene Name: importin 11
  Uniprot ID: Q9UI26
  ENST ID: ENST00000325324
  CDS Start-End: 170-3097
tttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagata

SEQ ID NO: 142498 - DNA, 3564 bp, Homo sapiens
  Payload ID: 8161
  Gene Symbol: IPO11
  Gene Name: importin 11
  Uniprot ID: Q9UI26
  ENST ID: ENST00000409296
  CDS Start-End: 131-3178
atagcaccaggtgtgaaactgctgggtcatagaagatacagtcacgagttgcttaaggctgggatacatcctgagaaatgggtcgttaggcaattttgttgttctatgaacatcatatgaacaaacctagatggtacagcctattatacacttgggctatgtggtatatagcttattgtatctaggctataagcctgtacagcatgttactgcactgaatactgtaagcagttgtcacaaaatggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctg

SEQ ID NO: 142499 - DNA, 1725 bp, Homo sapiens
  Payload ID: 8161
  Gene Symbol: IPO11
  Gene Name: importin 11
  ENST ID: ENST00000409534
  CDS Start-End: 177-461
ggaggtcagcagtgccacagaacaaactggagttaagaaatgtcgttcttcagatttaaaaagaaaacctttactgaatcagctgagtgttaataatacgaatttccttttcttgtgttatccaagataaattctgtgggattataaacatttcagtagaaggcctgcatgatgtcatgacggaagatcctgaaacaggaacttataaagactgtatgttgatgtctcatcttgaggaaccaaaagtaacagaagatgaagaaccacccacagaacaagataagaggaaaaagatgctggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaaaatatggtccaaattaaattttccaaagatacctca

SEQ ID NO: 142500 - DNA, 3005 bp, Homo sapiens
  Payload ID: 8161
  Gene Symbol: IPO11
  Gene Name: importin 11
  ENST ID: ENST00000424533
  CDS Start-End: 114-2705
gaggactgcagtctggagttggagcccttgtcccaaccagggctggataagaaggtgttggtgtggtgctctcggtgttgcgaaggctgtttaagttatatgatgaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatttagcttctggaatttataattttgcctgctctctgtggaatcaccacacagacacattcctgcaagaagtttcttctggcaatgaagctgcaattttgagttcactagaacgaacactgctatcattgaaagtgctgcgtaagttaactgttaatggatttgtggaacctcataagaatatggaggtgatgggttttttacatggaatatttgaacgtctaaaacagtttctggaatgcagtagaagtataggtacagataatgtgtgtagagatagactggaaaagaccatcattctttttactaaagtgcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaagatagcagccctgaaactcttgaagcccataagattaagatggcattcttcacatatcctactttgacagagatatgtagaagattagtctctcattatttcctattaactgaagaagaactgacaatgtgggaagaagacccagaaggctttacagtggaagaaacaggaggagattcttggaaatatagtttgaggccatgcactgaagtattatttatagatatattccatgaatataatcagactcttactcctgtacttctagaaatgatgcaaacacttcaaggacccacaaatgtggaagatatgaatgcactgttaatcaaagatgctgtgtataatgctgttggattagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggtccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagagtgaagaacacaatatgttgagatgtgctattttgacaacacttattcatcttgttcagggattaggagcagacagcaagaacctgtaccctttcctgctcccagttattcaactgagtacagatgtttcacagcctccacatgtttatcttctggaagatggtttagaattatggttagtaactttggaaaacagtccatgtattacaccagagttgcttcgtatatttcagaatatgtcaccacttcttgaactaagttcagaaaatcttagaacttgctttaagatcatcaatggttatatctttttatcatcaacagaatttttacagacatacgcagtaggtctatgccagtccttttgtgaacttttaaaggaaattactacagaaggtcaagttcaggtgctcaaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagccaattctgatctgaacagaaaatccaagaacagggatatgtgtggattacagttttctctgccttgcctacgactgtttctgccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagct

SEQ ID NO: 142501 - DNA, 1368 bp, Homo sapiens
  Payload ID: 8161
  Gene Symbol: IPO11
  Gene Name: importin 11
  ENST ID: ENST00000413749
  CDS Start-End: 1-180
atggaccagcttttgggaaatatgattgaaatgtgggttgatcgaatggacaacattacccagcctgaaagaagaaaactttcagctttggctttgctctctcttctgccatctgataatagcttcctgtatccatggcaacctctgttttacacattgactgtaaaggaaccaatgtgaagagtggtgtttcctgagcaaacggtgacttaaaaaaaaaaaaaaaaaagtggtggggtggaggtcagcagtgccacagaacaaactggagttaagaaatgtcgttcttcagatttaaaaagaaaacctttactgaatcagctgagtgttaataatacgaatttccttttcttgccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgtttttaataatttgtgaacagtgtattcatt

SEQ ID NO: 142502 - DNA, 1865 bp, Homo sapiens
  Payload ID: 8161
  Gene Symbol: IPO11
  Gene Name: importin 11
  ENST ID: ENST00000511713
  CDS Start-End: 1-482
tgttgagatgtgctattttgacaacacttattcatcttgttcaggttgtggaaaatgcccttaaagtgaacccaatactaggtccacaaatgtttcaaccgattttaccctatgttttcaagggtattatagaaggggagaggtatcctgtagtgatgtccacgtatcttggagttatgggtcgagttctactacaaaacactagttttttttcttcactacttaatgagatggcccataaatttaatcaggagatggaccagcttttgggaaatatgattgaaatgtgggttgatcgaatggacaacattacccagcctgaaagaagaaaactttcagctttggctttgctctctcttctgccatctgataatagtgttatccaagataaattctgtgggattataaacatttcagtagaaggcctgcatgatgtcatgacggaagatcctgaaacaggaacttataaagactggccctgaaggaccctgttcatacagtgtcactgcagcagttcatctacgagaagctcaaggcacagcaggagatgctaggagaacaaggtttccagtccctcatggaaacagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaaagaccacacattttttactacaaaatgtaaaggataaatgtaaatcctgcataactaaaatcacaaacctattcctcaaaagaatttaattttatatttatgagggggcccttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagctaatgaaactacaggtttgaaaaatgacaaagctgttcagatgatgctattaaagaaatgtgtgtactaagcaaaaatatataaatagtgacaaatacacattaccaagcttatcttgcaagggagttattttcatctaacatagaaagtgtgttttatcagacaaatgcttttattttcattctaataatttgatacagaaattagtaaaggcatttttttctttttttttccagtaaatacattgggtctataaatgtgcatttgtaagggccacaaaagtgaacgtgtggtactgtagtaccacgtgggagacctctggttatggtttagtcctagttcctttgttactcctgtgagcaccgagaagaactgggcgactcccagtcccacctgtgctgtgacagtcccacgtggctatgacagactgtttagtacttacccttctcaggttcctcagtgcaggggtgcatcagggcctcaataataggggtatacctgggaggatccagcagtaatccccagggtactaggattactagtactctgatggaactagtcttccttccttattcctcgaacatgcagtacataaaaaggggaaaaggagaaaaaaaaagccttactttgttttacttgccatttattgtaaggaaactttaaagcattttttaggaaatactcaaaagcaaggttggaaaatgttttatctttctatagaaagttgggtacagtatgtaactgcgggaaacccactgcccctttgtaagctgtggaacccaaactgtatggggatatttgatgttttcagaaagaggaagaa

SEQ ID NO: 142503 - DNA, 530 bp, Homo sapiens
  Payload ID: 8161
  Gene Symbol: IPO11
  Gene Name: importin 11
  ENST ID: ENST00000505902
  CDS Start-End: 340-530
gacaaagcccctccttccccttcccgccgttcgcctatcgccttctctctctgccggtcgcatgcgcgctggtctcctgtgacgtagttttcgcgcgtccgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacgctaaggagacaccagagggtgatggttgacagtagttggtacctcacagctgggcactgatcaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtact

SEQ ID NO: 142504 - DNA, 584 bp, Homo sapiens
  Payload ID: 8161
  Gene Symbol: IPO11
  Gene Name: importin 11
  ENST ID: ENST00000514647
  CDS Start-End: 139-584
actgccgggaattggagtcacagagggaggaaggccgaaccgcgggagcctacagatcccagaagacaccgcgctaccgaggactgcagtctggagttggagcccttgtcccaaccagggctggataagaaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattact

SEQ ID NO: 142505 - DNA, 554 bp, Homo sapiens
  Payload ID: 8161
  Gene Symbol: IPO11
  Gene Name: importin 11
  ENST ID: ENST00000506200
  CDS Start-End: 69-554
acatgcttttaatgaaaaagtgaaggtagttgtccgtttatagagaggagcttcatggagaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctgaatattttcaccaaccacactttggatataaatgtaaggtggcttgctgtactgtattttaaacatggaattgatcgctactggagacgtgtagcacctcatgctctctcagaggaggagaaaactactctgcgtgcagggctcatcaccaacttcaatgaaccaataaaccagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacga

SEQ ID NO: 142506 - DNA, 1201 bp, Homo sapiens
  Payload ID: 8162
  Gene Symbol: IPO13
  Gene Name: importin 13
  ENST ID: ENST00000372339
  CDS Start-End: 586-1131
cttcacttcatctcttccccctcacccacagcagcactggctccttggtgtgtgtatggccgaagagggcctggacacagggtaccctgggtgaaagatggggctgaggctccaaggctcctgctgtacttttcttctttttgagcaggagctggagggtgcctcaggaatacaggagggacatgggaggagggctgttgggctgagggctccctgtctggctgccatctcttcttcctgctaccctgttcacaaactgggggtgcttaactccctctgtgaatcaacatgaagtcactgctggcaacctagagcctgcgagacatctggccctgatggagggggagggaaaggtgtctggaacccaaactttctgcattatgatccccacccccaacctctctcacgtacacctgcgtgttcatgtacacatacatgtacatagcatcccttgagctgtcctcacctgacctactgaactctgaggtggtccgggtcccccagagatggctgggtagctggttttggcagcctctacctgtgaggtgtgaagttgggggctggggtggcaggtgagtgggggggatggtccttggagctggctggggctgggcttaccagctccacctcctgcaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctc

SEQ ID NO: 142507 - DNA, 3894 bp, Homo sapiens
  Payload ID: 8162
  Gene Symbol: IPO13
  Gene Name: importin 13
  Uniprot ID: O94829
  ENST ID: ENST00000372343
  CDS Start-End: 663-3554
cggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgacgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgca

SEQ ID NO: 142508 - DNA, 3646 bp, Homo sapiens
  Payload ID: 8163
  Gene Symbol: IPO4
  Gene Name: importin 4
  Uniprot ID: Q8TEX9
  ENST ID: ENST00000354464
  CDS Start-End: 178-3423
gctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaata

SEQ ID NO: 142509 - DNA, 535 bp, Homo sapiens
  Payload ID: 8163
  Gene Symbol: IPO4
  Gene Name: importin 4
  ENST ID: ENST00000561034
  CDS Start-End: 36-182
cttttcggcccagtagcggcggctcagttgctgccatggagtcagccgggctagagcagctcctacgggagctgctgctaccggacaccgagcgcatccgtcggcttccccccaggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagtaagtacctacccacttctctcgggatcttgacgactttgtctaggtttctgccttccttttcggctccaggctgggacttgtggggcagggacttcagttctagacgcaaggtggagtgaggattttaaggctgttttgaagactaaagttcttgaggaagggtgatgatgatctgccaaacccaagtcagaagaataagactgaaatt

SEQ ID NO: 142510 - DNA, 3440 bp, Homo sapiens
  Payload ID: 8163
  Gene Symbol: IPO4
  Gene Name: importin 4
  ENST ID: ENST00000558046
  CDS Start-End: 11-475
agttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttg

SEQ ID NO: 142511 - DNA, 3540 bp, Homo sapiens
  Payload ID: 8163
  Gene Symbol: IPO4
  Gene Name: importin 4
  ENST ID: ENST00000558780
  CDS Start-End: 36-341
cttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagaatctctcctgtttgcaggcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcagcccctgacctggctccacaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaat

SEQ ID NO: 142512 - DNA, 579 bp, Homo sapiens
  Payload ID: 8163
  Gene Symbol: IPO4
  Gene Name: importin 4
  ENST ID: ENST00000559253
  CDS Start-End: 58-354
acgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagaatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatg

SEQ ID NO: 142513 - DNA, 1864 bp, Homo sapiens
  Payload ID: 8163
  Gene Symbol: IPO4
  Gene Name: importin 4
  ENST ID: ENST00000561462
  CDS Start-End: 1-1642
tcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccaggtgaggacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaat

SEQ ID NO: 142514 - DNA, 1015 bp, Homo sapiens
  Payload ID: 8163
  Gene Symbol: IPO4
  Gene Name: importin 4
  ENST ID: ENST00000558233
  CDS Start-End: 1-937
cccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctg

SEQ ID NO: 142515 - DNA, 3485 bp, Homo sapiens
  Payload ID: 8163
  Gene Symbol: IPO4
  Gene Name: importin 4
  ENST ID: ENST00000560155
  CDS Start-End: 83-2818
tccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcagcccctgacctggctccacaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttac

SEQ ID NO: 142516 - DNA, 6003 bp, Homo sapiens
  Payload ID: 8164
  Gene Symbol: IPO5
  Gene Name: importin 5
  Uniprot ID: O00410
  ENST ID: ENST00000261574
  CDS Start-End: 181-3528
gacctcccacaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacagcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgcac

SEQ ID NO: 142517 - DNA, 4335 bp, Homo sapiens
  Payload ID: 8164
  Gene Symbol: IPO5
  Gene Name: importin 5
  Uniprot ID: O00410
  ENST ID: ENST00000357602
  CDS Start-End: 375-3668
gatacttgctgtaagtagcaaaaagatgggaaggaaagtctacagaccaaatcatatctgaatctccccattctccctctccacaaatattggtttaggaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagccccaggcgtgagtcactggagagcgcgacgggaggaaggggcgccctgagtccacagccctgggggaggtcggagggtctgaaagcgagaagtccgtgagtagaagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggc

SEQ ID NO: 142518 - DNA, 547 bp, Homo sapiens
  Payload ID: 8164
  Gene Symbol: IPO5
  Gene Name: importin 5
  ENST ID: ENST00000403772
  CDS Start-End: 1-547
gcggccgcggcggagcagcaacagttctacctgctcctgggaaacctgctcagccccgacaatgtggtccggaaacaggcagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttca

SEQ ID NO: 142519 - DNA, 564 bp, Homo sapiens
  Payload ID: 8164
  Gene Symbol: IPO5
  Gene Name: importin 5
  ENST ID: ENST00000421861
  CDS Start-End: 245-564
gaaatgtgtatgtcatgtgtccaaattgtaagatacttgctgtaagtagcaaaaagatgggaaggaaagtctacagaccaaatcatatctgaatctccccattctccctctccacaaatattggtttaggaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccat

SEQ ID NO: 142520 - DNA, 542 bp, Homo sapiens
  Payload ID: 8164
  Gene Symbol: IPO5
  Gene Name: importin 5
  ENST ID: ENST00000496368
  CDS Start-End: 249-542
atgtatgtcctcacaatgcaggaggtgaaatgtgtatgtcatgtgtccaaattgtaagatacttgctatactttcccagcaacatctagactgctgtttgaccaaacaacggggctccaacagcctagccaagtgaaacataaaactaaccatcacagtatccttgtcaaaaatcagtctgacaacacatcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagca

SEQ ID NO: 142521 - DNA, 536 bp, Homo sapiens
  Payload ID: 8164
  Gene Symbol: IPO5
  Gene Name: importin 5
  ENST ID: ENST00000497270
  CDS Start-End: 23-403
cttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagcatcatctttaggttgaagaaacatttaatgtcagcttagcagcacaattgtcatttcacaaaagttcaaatatcgggggacgtttaaaaagaaaacatctgtaattcatctatgaggatggcaataaccagtggcccgaaggtttgaag

SEQ ID NO: 142522 - DNA, 524 bp, Homo sapiens
  Payload ID: 8164
  Gene Symbol: IPO5
  Gene Name: importin 5
  ENST ID: ENST00000485433
  CDS Start-End: 299-524
attgttctttggtattgtgccttacgtgagctggggactaactctgtatccttaaggaggcatcacttgattagagttgcccaaaagaatgtgggttattatcctaaaggtctgtgttgccatcctgaaacagtcagaaatcagtttttatttcacttaggtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagagg

SEQ ID NO: 142523 - DNA, 522 bp, Homo sapiens
  Payload ID: 8164
  Gene Symbol: IPO5
  Gene Name: importin 5
  ENST ID: ENST00000489058
  CDS Start-End: 373-522
agccgggaacagctctgaccacagtaagtcatcccaaaacctcacattcagatgaaaccatttaagaatttcatctgcactgaggaacaatttagcgtgatactggagggaaagagtttccctgtgagatccaggaggtccctttagctcgtctcctgacgtcaccacagtcatacccaagaggaaggaaacgtcagagacaatgatttggagaacattctacacaaaaaccaagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggtaacc

SEQ ID NO: 142524 - DNA, 3419 bp, Homo sapiens
  Payload ID: 8164
  Gene Symbol: IPO5
  Gene Name: importin 5
  Uniprot ID: O00410
  ENST ID: ENST00000490680
  CDS Start-End: 66-3359
gcggcccgcgagcgcgcctcacggctcctgtctcccctccctccttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttccttta

SEQ ID NO: 142525 - DNA, 543 bp, Homo sapiens
  Payload ID: 8164
  Gene Symbol: IPO5
  Gene Name: importin 5
  ENST ID: ENST00000480641
  CDS Start-End: 312-543
aaggccagtgaggcgccggcgccggcggccgcggcgggcgcaatggcggcggccgcggcggagcagcaacagttctacctgctcctgggaaacctgctcagccccgacaatgtggtccggaaacaggcagaggtgtgtgtctggtggttctaagcagtggtaatttgaaccagttgtacatcatccagtctaaaaatgttaacgaaacagtttctcatgatgaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttg

SEQ ID NO: 142526 - DNA, 544 bp, Homo sapiens
  Payload ID: 8164
  Gene Symbol: IPO5
  Gene Name: importin 5
  ENST ID: ENST00000493281
  CDS Start-End: 353-544
acaactggagcagccgggaacagctctgaccacagtggttccggggagaagcctttccaggacccatgtgtaggcacaactgttttccctgatcaggatacttgcggcactcaagaattctccgaagtttgaaggttatgaatggttatcactcaaggattcagaactaagatactttcccagcaacatctagactgctgtttgaccaaacaacggggctccaacagcctagccaagtgaaacataaaactaaccatcacagtatccttgtcaaaaatcagtctgacaacacatcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctctta

SEQ ID NO: 142527 - DNA, 542 bp, Homo sapiens
  Payload ID: 8164
  Gene Symbol: IPO5
  Gene Name: importin 5
  ENST ID: ENST00000490369
  CDS Start-End: 173-364
acaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagagacagatatgtttgaaaagtttgaaacctgtgtagcactgcataaatagaactggttgtttaatgaagtgaaacagagctttcagtaccagagagattttgaatatggttggccttagaggaccagagttctgtctgctattcattgtctatgatcttaggaaacctatgagaatatcccaggccagtcaaagatcacattcctcttacaagccatcagaaatacaa

SEQ ID NO: 142528 - DNA, 3505 bp, Homo sapiens
  Payload ID: 8164
  Gene Symbol: IPO5
  Gene Name: importin 5
  ENST ID: ENST00000469360
  CDS Start-End: 1-3299
ttttccggccattgctgccgcggcgcctggcaccagttacctccccgccgccgctcgcacccacgtgcggccgctcccgacgcgcccccgtccaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctg

SEQ ID NO: 142529 - DNA, 555 bp, Homo sapiens
  Payload ID: 8164
  Gene Symbol: IPO5
  Gene Name: importin 5
  ENST ID: ENST00000481455
  CDS Start-End: 197-555
gacctcccacaactggagcagccgggaacagctctgaccacatttttatttcacttaggtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacaca

SEQ ID NO: 142530 - DNA, 556 bp, Homo sapiens
  Payload ID: 8164
  Gene Symbol: IPO5
  Gene Name: importin 5
  ENST ID: ENST00000471898
  CDS Start-End: 334-556
acaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagccccaggcgtgagtcactggagagcgcgacgggaggaaggggcgccctgagtccacagccctgggggaggtcggagggtctgaaagcgagaagtccgtgagtagaagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttg

SEQ ID NO: 142531 - DNA, 591 bp, Homo sapiens
  Payload ID: 8164
  Gene Symbol: IPO5
  Gene Name: importin 5
  ENST ID: ENST00000480611
  CDS Start-End: 240-591
aagtatgaaacaatgacgatttcatgatggctcattgttctttggtattgtgccttacgtgagctggggactaactctaaatcagtttttatttcacttaggtggttccggggagaagcctttccaggacccatgtgtaggcacaactgttttccctgatcaggatacttgcggcactcaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatgg

SEQ ID NO: 142532 - DNA, 568 bp, Homo sapiens
  Payload ID: 8164
  Gene Symbol: IPO5
  Gene Name: importin 5
  ENST ID: ENST00000481689
  CDS Start-End: 183-568
acagtaagtcatcccaaaacctcacattcagatgaaaccatttaagaatttcatctgcactgaggaacaatttagcgtgatactggagggaaagagtttccctgtgagatccaggaggtccctttagctcgtctcctgacgtcaccacagtcatacccaagaggaaggaaacgtcagagacaatgatttggagaacattctacacaaaaaccaacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcact

SEQ ID NO: 142533 - DNA, 883 bp, Homo sapiens
  Payload ID: 8164
  Gene Symbol: IPO5
  Gene Name: importin 5
  ENST ID: ENST00000475420
  CDS Start-End: 372-883
aaattacgcctctaggttcctagactgagattgagataatcagccctgtaaaccagggctcctttaggaagaaaggtgtctctcttgacgttccccaatcattgcgagaacagaatccctaaacaagggattcaagggaacagtcacagatcctggggtgggggcatgtttgctacgtgtacatccgaagacgaccgcgggctggggacgggcggcctggcgggacagccccgggctgagtaacccctcttccgggcaagccccaggcgtgagtcactggagagcgcgacgggaggaaggggcgccctgagtccacagccctgggggaggtcggagggtctgaaagcgagaagtccgtgagtagaagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttaga

SEQ ID NO: 142534 - DNA, 493 bp, Homo sapiens
  Payload ID: 8164
  Gene Symbol: IPO5
  Gene Name: importin 5
  ENST ID: ENST00000463157
  CDS Start-End: 230-493
acaactggagcagccgggaacagctctgaccacagtggttccggggagaagcctttccaggacccatgtgtaggcacaactgttttccctgatcaggatacttgcggcactcaagaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttg

SEQ ID NO: 142535 - DNA, 544 bp, Homo sapiens
  Payload ID: 8164
  Gene Symbol: IPO5
  Gene Name: importin 5
  ENST ID: ENST00000460070
  CDS Start-End: 118-544
agaactgtgggattgatgacctcccacaactggagcagccgggaacagctctgaccacacagaggaaagaaattcctaagggaacactgctcagaaagtactgcagcatgtcttcaaatgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaataggtgtgtatg

SEQ ID NO: 142536 - DNA, 536 bp, Homo sapiens
  Payload ID: 8164
  Gene Symbol: IPO5
  Gene Name: importin 5
  ENST ID: ENST00000473582
  CDS Start-End: 42-536
acctgattgttgaggaaccagggtgttaatagataaaagtcatgtgtcccctcttttacttttcctcatacaaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcag

SEQ ID NO: 142537 - DNA, 192 bp, Homo sapiens
  Payload ID: 8164
  Gene Symbol: IPO5
  Gene Name: importin 5
  ENST ID: ENST00000631030
  CDS Start-End: 1-192
atgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagagacagatatgtttgaaaagtttgaaacctgtgtagcactgcataaatag

SEQ ID NO: 142538 - DNA, 6191 bp, Homo sapiens
  Payload ID: 8165
  Gene Symbol: IPO7
  Gene Name: importin 7
  Uniprot ID: O95373
  ENST ID: ENST00000379719
  CDS Start-End: 143-3259
gttctatccggggccttggcgcttctctttcctttcgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcactatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtggggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaacatc

SEQ ID NO: 142539 - DNA, 578 bp, Homo sapiens
  Payload ID: 8165
  Gene Symbol: IPO7
  Gene Name: importin 7
  ENST ID: ENST00000533233
  CDS Start-End: 113-307
cctttcgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcactatggacccagccctgcgtgaggccgcggagcgccagctcaatgaaacggagtttcgctcttgttgcccagactggagtgcaatggcacaatctcggctcgccacaacctccgcctcccggattcgggcaattctcctgcctcagcctcttgagtagctgggattacaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacag

SEQ ID NO: 142540 - DNA, 607 bp, Homo sapiens
  Payload ID: 8165
  Gene Symbol: IPO7
  Gene Name: importin 7
  ENST ID: ENST00000527431
  CDS Start-End: 216-607
ctttcgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcactatggacccagccctgcgtgaggccgcggagcgccagctcaatgaagtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtc

SEQ ID NO: 142541 - DNA, 195 bp, Homo sapiens
  Payload ID: 8165
  Gene Symbol: IPO7
  Gene Name: importin 7
  ENST ID: ENST00000630083
  CDS Start-End: 1-195
atggaccccaacaccattatcgaggccctgcggggcactatggacccagccctgcgtgaggccgcggagcgccagctcaatgaaacggagtttcgctcttgttgcccagactggagtgcaatggcacaatctcggctcgccacaacctccgcctcccggattcgggcaattctcctgcctcagcctcttgagtag

SEQ ID NO: 142542 - DNA, 5325 bp, Homo sapiens
  Payload ID: 8166
  Gene Symbol: IPO8
  Gene Name: importin 8
  Uniprot ID: O15397
  ENST ID: ENST00000256079
  CDS Start-End: 340-3453
acagcagcatggcggccgccgacgggaggcggtcatagcatcacgcccgggggaagaggccgccgtaaaggaagctctgcttcctcttcttccttctcccgcctcccaccggctgtcgtaaaacggtgaatggagagcgagttgtgggggggaaaaagggaggacagggggcgcggagtcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtcctacaagattatcaattttgcccccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcagtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttcttcagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccagga

SEQ ID NO: 142543 - DNA, 544 bp, Homo sapiens
  Payload ID: 8166
  Gene Symbol: IPO8
  Gene Name: importin 8
  ENST ID: ENST00000543446
  CDS Start-End: 291-544
gttccccaaatcctcaccaactctgtacaacttaatgaagttttgatgtaaaatgtaaacagcattgaaaggcatttttttcttcataatttgttttttcataatttagatttcaaatcctaaatttaagtggtatttataaattttctgttctgtttaatctattattaaaatacaaggatgctccaagacacctagaaagataatttatctttagcatgacacttaaaaaagaatgttgtgatttttgctttaaaagaaagcctgtataaagctgtaaaaaaaaagttatgctaatgttaagtggaaatacatctgcaaaatactttttctcttttgcttgtgggcaatctaaagtgttcttgctaccatcaagcgtgctcactgctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgag

SEQ ID NO: 142544 - DNA, 535 bp, Homo sapiens
  Payload ID: 8166
  Gene Symbol: IPO8
  Gene Name: importin 8
  ENST ID: ENST00000542464
  CDS Start-End: 35-535
aagcttcgtgagggcaaagattgtctatcttattatgtctgtagcatgtagcatgttttgtactgaatggatgtggaggcaatatccgtcttctgcaactcacagtacagcagagtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttcttcagcaagcattcaactatctcaaccaaggggtggttcattctataacctggaagcagatgaagccacacatacagaatatctctgaagat

SEQ ID NO: 142545 - DNA, 537 bp, Homo sapiens
  Payload ID: 8166
  Gene Symbol: IPO8
  Gene Name: importin 8
  ENST ID: ENST00000535989
  CDS Start-End: 85-537
agaatgctaggttccccaaatcctcaccaactctgtacaacttaatgaagttttgatgtaaaatctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcag

SEQ ID NO: 142546 - DNA, 792 bp, Homo sapiens
  Payload ID: 8166
  Gene Symbol: IPO8
  Gene Name: importin 8
  ENST ID: ENST00000540979
  CDS Start-End: 223-330
gtaaaacggtgaatggagagcgagttgtgggggggaaaaagggaggacagggggcgcggagtcagagtggcgcagcaagtggccgcaggtggcgacggtggcggggggtggggtgtgaggtaatccaggggtcgcggaagaggaggctgagagggtcaaaagaaaactaaagctgcagtccggcctactgttccgggggccgcggagcccccacccggggagatggacctcaaccggatcatccaggcgctgaagggcaccatcgacccgaagttgcggattgcagccgagaacgagctcaaccagtttacttcggattatagtctctgaccatgtggaattcccagtacgacaggcagctgccatttacctgaagaacatggtgacacaatactggccagatcgagaacctccaccaggagaagcaatatttccattcaacattcacgaaaacgatcgccagcaaatacgtgataacattgtggaaggaataattcggtctccagatttagtgagagtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattact

SEQ ID NO: 142547 - DNA, 526 bp, Homo sapiens
  Payload ID: 8166
  Gene Symbol: IPO8
  Gene Name: importin 8
  ENST ID: ENST00000358724
  CDS Start-End: 426-526
ttagaatgctaggttccccaaatcctcaccaactctgtacaacttaatgaagttttgatgtaaaatattgatcctgtgaaatcaggctgggtgttcatgcctgtaatcccagcactttgggaggctgaggtgggtggatcacttgagcccaggagttcaagaccagcctgggcagtatggcgaaaccctgtctctacaaaaatacaaaaaaattaactggcgtggtggtgcacgcctgtattcccaactacttgagagactgaggtgggaggatcacctaagccctggaggtggaggctgcagtgagctgtgattgtgcccctggactccagcctgggcgatagagtgagaccctgtctcaaaaaaacccctaaatcctgtgaaatcagtctgaactgctgacagctgccatttacctgaagaacatggtgacacaatactggccagatcgagaacctccaccaggagaagcaatatttccattcaacattcacgaaaacgatcgccagcaaatacgtgataacat

SEQ ID NO: 142548 - DNA, 3212 bp, Homo sapiens
  Payload ID: 8166
  Gene Symbol: IPO8
  Gene Name: importin 8
  Uniprot ID: O15397
  ENST ID: ENST00000544829
  CDS Start-End: 326-2824
attgttgtatatgcagtctgtcactgaccgaaacatttgttatgtggtgcatgactttatatacattttttccagttagagtgtaagcttcgtgagggcaaagattgtctatcttattatgtctgtagcatgtagcatgttttgtactgaatggatgtggaggcaatatccgtcttctgcaactcacagtacagcagaggtgagccatatatctgtttagtacaaagtggactgtagttattatgctacagtgtagaggaaagtaatttaaaaaaatgtttcatgagtgtttaatgaaataaatattttcatcaaggtggttaaaatggaaagtttgaccctcaaagggtatgcattgcctcttcagctagtgaataaccaaaccatgacaacatggatggagatcttccgaactattatcgacaggaccgttcctcctgagactctgcacattgatgaggatgatagaccagaactggtatggtggaagtgtaagaagtgggcactgcatattgtagctcggctctttgaacgatatggaagcccaggaaatgtcacaaaagaatactttgaattttctgaattctttttgaaaacctatgcagtgggcattcagcaggtgctactaaaaattttagatcaatatagacagaaagaatatgtagctccccgtgttcttcagcaagcattcaactatctcaaccaaggggtggttcattctataacctggaagcagatgaagccacacatacagaatatctctgaagatgtgattttttctgtgatgtgttataaagatgaggatgaagagctgtggcaagaagatccatatgagtatataaggatgaaatttgatatttttgaagattatgcttctcccaccacagcagcccagactctcttatatactgctgcaaagaaaagaaaagaggtgttgccaaaaatgatggcattctgttatcaaatcctgacagacccgaactttgaccctaggaagaaagatggagccctgcatgtgattggttccctagctgagattttactgaagaagagtttattcaaggaccaaatggagctgtttctacaaaatcatgtatttccattattattgtctaacctgggatatcttcgagctagatcttgctgggtacttcatgcatttagttctttgaagttccataatgagctcaatctaagaaatgccgttgaattagcgaagaagagcctgattgaagataaagagatgcctgtcaaagttgaagctgcccttgctcttcagtctttaatttctaaccagatacaagctaaggaatatatgaagccacatgtgaggcctattatgcaggaactgttgcacattgttagagagacagaaaatgatgatgttactaatgtcatccagaagatgatatgtgaatacagtcaagaggtagcctcaattgctgttgatatgacccaacacttggctgagatatttggcaaagttcttcaaagtgatgaatatgaagaagttgaagacaaaacagtaatggctatgggaattttacataccattgatactatcttaacagttgtagaagatcataaagagattacccagcagttagagaatatctgtctacggatcattgatcttgttctgcagaaacatgtaattgaattctatgaagaaattctttccctggcatacagtttaacctgccacagtatttcccctcaaatgtggcagcttctaggtatactatatgaagtgtttcagcaggattgctttgaatactttacagacatgatgcctctcctgcataattatgtgacaatagatacagataccttactatcaaatgcaaaacatttagaaattctttttacaatgtgtaggaaggtactatgtggagatgcaggagaagatgcagagtgtcatgcagctaaacttctggaagtcatcattcttcagtgcaaaggaaggggaattgatcagtgcattccactcttcgttcaacttgttttggagagattaactcgaggggtcaaaactagtgagcttcgtactatgtgtcttcaggttgcaattgctgccttgtactacaaccctgatttgctgctacatactttagaacgaattcagttgcctcacaaccctggacctatcactgtacagtttataaatcaatggatgaatgatacagattgttttcttgggcatcatgaccggaagatgtgtataataggactgagtatccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcagaggcaaagaagaagattgaacaacagggaggcttcacctttgaaaacaaaggagtcctctccgcatttaattttgggactgtgcccagcaacaactgaaggaaagaacatcagctgaccaaatgtcatcgctgcattttatttcacaagaggagtgtgagggtcaaggggatgaaatgaggggctgcttttagggccctcctgctgtgccagttaccatctggcattaggcagcacttttatctactctttcccctttgacctttgtcaccctgaaatatatattttaaacagctactgtaagtatgaaatgaaagaaaaacaatcattggacggaaaaggacaacccatatgttccaaaggctgaatgcccaaggttgttttagaggattggatagacttgcacgtctcaggtttttgccatgcagaatcaatggatttatgcggataacagtgccttctgttgtacatgaattatcagaaaaaa

SEQ ID NO: 142549 - DNA, 758 bp, Homo sapiens
  Payload ID: 8166
  Gene Symbol: IPO8
  Gene Name: importin 8
  ENST ID: ENST00000535598
  CDS Start-End: 1-503
tccttttggaattgcaaaatcgacctcctgcagtagatgctgtggtgggacagattgttccctcaattcttttccttttccttggcctaaagcaggtctgtgctactagacaactggtaaaccgggaagatcgttcaaaagcagagaaagctgatatggaagaaaatgaggagatttcaagtgatgaagaggagacaaatgtaactgctcaagcaatgcagtcaaataatggaagaggtgaagatgaggaggaggaagatgatgactgggatgaagaagtattggaagaaaccgcgcttgaggggttcagtactccacttgaccttgacaatagtgtggatgaatatcagttttttacacaagctctgataactgtgcagagtcgagatgcagcctggtaccagctgctgatggcaccactcagcgaggatcagaggacagcactgcaggaggtgtacacactggcagagcaccgacggacggtggcaggtcagccagagtaacctccagagtggagtgcatgtgtcagagtgccaacagacagccttatttgatgagccaggtggcacctaaacactgtttttgaaattgttagagacttaccctttaagataataaggaattgtcattattgtatgattgttttaatcactcatgatgtcttagctttgcaaaaacctgcacattaatatgtatttcctagtggtgttctcattcacattcttatcctatgttggaggcaaaggtacaaagtaagg

SEQ ID NO: 142550 - DNA, 239 bp, Homo sapiens
  Payload ID: 8166
  Gene Symbol: IPO8
  Gene Name: importin 8
  ENST ID: ENST00000545077
  CDS Start-End: 102-239
ctgtcgggttggcaggactgttttgacaccgattggccgagttttgcggagcgctgggcagtgctgttgggagagtgctctgggaagaataggcagttttcatggtgatactgctttatctaagacacatcaaatcctacaagattatcaattttgcccccagtttacttcggattatagtctctgaccatgtggaattcccagtacgacaggcagctgccatttacctgaagaacatg

SEQ ID NO: 142551 - DNA, 426 bp, Homo sapiens
  Payload ID: 8166
  Gene Symbol: IPO8
  Gene Name: importin 8
  ENST ID: ENST00000611458
  CDS Start-End: 1-426
agtccaattaacaatgtgtctccgtgccatcataaaacatgattttcctggtcactggccaggagtggtcgacaagatagactattacttgcaatcacagagcagtgcaagctggcttggcagtttattatgcctgtatcaactggtgaagacatatgaatataagaaagcagaagagagagaacctcttataatagcaatgcagatattcctgcctcgtattcagcaacaaattgttcagctccttcctgattcctcctattattctgtattactgcagaaacaaattctgaaaatcttttatgcacttgttcaggtaggtttctattgcagaaaacaaacatggagtcctgtatttctgcctgacacatggaaagtgctcaataagtgtcacttattattaaaaattattttgtattatcccat

SEQ ID NO: 142552 - DNA, 11435 bp, Homo sapiens
  Payload ID: 8167
  Gene Symbol: IPO9
  Gene Name: importin 9
  Uniprot ID: Q96P70
  ENST ID: ENST00000361565
  CDS Start-End: 70-3195
gccgcgcgcgggggccgtcattcggtggcgggtcccggccgcggggctggcgggctgaggggagaaaagatggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtaacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggtataaggtgtctcagcacctgtttgccttctattccctttagaaggtaagtaaaagtaatgggggaaaggattaggtggagcctgtctaaacattctagtgtgtcttggcaaacatagcctgaaatgattcttaaagaactggcattgtttaatcaaatatttttaagggagattccttaattgggaagtttagtctgtttggggttcaaagagtaaatgaggattagaaaatcatggagagaggctgggcgcggtggctaacgcctgtaatcctagcactttgggaggctgagatgggcggatcacttgagatcaggagtttgaggctagcctggccaacacagtgaaacctgcatttctactaaaaatacaaaaattagctgggcatggtggtgcatgcctgtaatcccagttaacttgagatgctgaggcaggagaatcgcttgaacttgggaagcagaggttgcagtgaaccgatatcacaccgttgcattccaaggcaagactcaatcacacacacacacacacacacacacaaatcatggggagaaagatgaaacctgtgttcccctttttttggtagtgcccacatctggtgccccatttttaataaccacaggatatttctttagattgatattctcacaaagaagaaatagaatataggctgggcgtggtgtgtcacacctgtaatcccagcacttacggaggccgaagccagcggatcaccagaggtcaggagttcgagaccagcctgaccaacatgatgaaaccctgtctctactaaaaatacaaaaattagccaggcatggtggcatgcacttgtaatcccagctactcgggaggctgagacaggagaatcgcttgaacctgggaggcagaggttgcagtaagccaagatcgcaccattgcactacagcctgggcaacaagaggagcgaaactctgtctcaaaaaaaaaaaagagaaagaatataaagtgaatctgaatctccactcaaggggatggccccaaggatattgtagctggtaatttcttcatgccactaggtgtccccagtgttcaacctccatgactgagattggaagaagtagagttaaaagtttttactacctttgagaagcctgcgggcatgttcacagtcgtcccatgccagccaggttctgaggctaactgcttgtgcccctgctgcttcacatggcattgtgggagttgctgatactggggaaatgatggcagatctgaccaagtggtgctgagaaaaccaccctcggccttgcagactccatagtttatctcaaggcagtgccagtcggatttggtgctaaaggcataaggccaagtcagcctctgatattggcacaaaagaatggtctcatgccagtagcattgaactgctgagcttgggaaggcttaaggctcccacacacagactgagaatgatgggggtccctctgcgtctgctaattagacaaacattctatatctagtgccaaaagtggtcctaaatcctttggcaagggtcctttctgctctcatgctgatttgggggaggactgggcatcctgcctcaggagaacttgagtcctgaggaaagggccctagtaacacttaagggctacccctggctaacagatactcggctgtgggtgagagcagaaggtcttggacccctcgatgtgcaggtacttaattgtgtttccagtgcattttcatatacattatcccatttaacctttataacaggttcacagagtggatattcccattctgttgatgagaaaaagagtggagagactgtgtccagtgtcagcaggaagaaaaaagatctgttggaggccagtacatgttgacagaaactctagaccatattttgtctcctgtctttggccaaagagaactagcttcagtctgaaaagggcagggctaagtggttacaaggaactaaaaagttcaaggtaagacaaatgaggtaaaaataaaaaagagcacttagctgctctgagacattttagtctcctgactggtaaacagcagctggggcaccaaggggctcccaggagtttgtcgagcttttattggagtgaactgaaaggaaaatggaaggaatgctataagactgaaaagaagttaaagccctaggaaggaagctgataacacaagttacagacgtatatgtgacattgatttgggagaatgaacctacaacaaatgacccaaaagcacctaaataagagtgacgagagtttaacagacattcattatggacttcagagaaaatgatgctaaactggtcttagaatcttctttaattttgttaactaggtaaataatctggacattttagtcaaagcattagacagacagagaagttggtaactgaccactaactaacaaactataaattcacccattgtgggttgacctggtaagttcccccagggctgtgtccttggcccctcctttgatattagtgacagatgactttttttatgccttacccattccacaaaagaatttgaagccatttacacaagagatagtactagtaaattaggagtgctgatcaaatttttagataataagaaacccttaggaaggatgacaatttagaatccaaatttaggatccaaacaaataccattacaaactataaaaatgagcagaatctaaatgtaacatttcaataaatgcagattgataataacatctgtgcagagttgaggactatagagtactgtgctgtcactaacagtattgtgtgctactaagagtttaatggctgggtgtggtggctcacacctgtaatcccaacactttgggaggcctaggtgggtaaatcagctgagatcaggagttcgagaccagcctggccaatgtggtgaaaccccgcctctactaaaaataaaaaaattagctgggcatggtggcacgtgcctgtaatcccagctactcgggaggctgaggcgggagaatcacttgaacctgggagacagaggttgcagtgagtcgagatcacaccattgcactccagcctgggcaacagagcaagattctgtctcaaaaaataaagtttattatgccaggagggccaggtgtggtgccacacccatgtaatcccagcactttaggaggctgaggagggcagatcacttaagcccaagagtttgagaccagtctgggcaatgtggcaataccttgtctcttaaaatttaaaataaaaaaaaagtttattatgccaggaactgttaatgtgtccaaaaaaactccagtgtggttctaggatgagataataaaaacaggttgtctagggtagtgtggaaggtcctttcagtcttcctgtgcctatcagtgatcctcattgccatgttcccttctggtgctcaaccggaggctccctgacagatgagtcctctgccagaggaaggctaagatgtagaggacaaatcgtgtcaaggaaaagaagcttgaaggagctaagaatgcttagcttagagaagacaagaggaaacaggacatggctttgggaagttcaaggatggtccagtgaaatacatactatacttttgcaccccagctaagctgacccatgatcagtaagtaggaaataaaaggccaatttctggctactcttgcccccaaccccatttcagtgaactatgaacctctattagatatgcaaggccggtgctaaatgctggagggctttggccctttccctcaaggagctagtctagtagggggtcagaaatacagatgggcctgaacataatgatggtttgacttccagtttttcaactttaggattgtgcaaaagctatacacattcggtagaaacagtacttcaagtatccatacaatcagtacagtattcaataaattacatgagacattcaacactttattataaaataggctttgtgttagatgagtttgcccaactgtaagctaatgtaagtgatctgagtaggtttaaggtagcctaggtgtattaaatgcatttttcacttaacggtattttcaacttttgttgggtttattgggatgtagccccattataagctgaaaagcatctgtagtataataaatgtggggagtgctgtgagagaaataagtgtactgggtttagttcccactgcccaaaaaaggaactggctaatggtaacctgggggaggaagtcgggtaagttgcatggagaaggcaacccttgaacacttgcaaggagctaacaatacctgcttctggagtatttaaacgccagtgggtatgctaaatacttttacctcagaccacctactaaccttacaaagtagtccactttgctcacccagttttacagattgatgaaactgaagcagacagatattgttaacctatcaaaggtcaccctgcaagtgtgtgattatagtccaagcagcttgtacttgttgcctatttgttttgcctttcctgtgcatttgccaggcagatgagagtggggtaagacattgcagagaaaaagtaagaaaaggccgtcatgaaacaatttcattttcagaccttataagcacgttacaagtactgatatttatgcttaagttcacgggagtcctggccagaaataaagctggaaggacaagtggggggcagattgtgaaggatccttcaagacctgcttcctctagagaatgggagactacccaagataactaaacagggaagtgatcaggttttgtgtcttagaaaagtgttgcagtgttgatgcaaatgtgactagaagggtgacttggaacctggattgaaggggtgggagatgggagaaaggaatgcagtctggcagcagctacagcagtccaggtgggaaaacccagagcctgaactaaggttgtaactagaggggatagggtggaagagctggattagagatgttgacaagataaagtcagtaggacttaaagactgacaagtaaggattttccaaaagtgagagctgtggaatgaattgtcttaaaatgttgcagtgagttcctcctcatcaatccaagtgctcgatcagaggctagacctttagttagcagtcacgggaaaattccccattctcacggggatttagactaggtcttaaccatactttaccaagattccagtagcaaagcacccaaaagtaatcgcaataaaattccaatttttgtaggccgggcatagtggctcacacctgtaatcccagcactttgggaggccgaggcaggcggaccacgacatcaagagttcaagagcagcctggccagcatggtgaaaccccgtctctactaaaaatacaaaaaaattagctgggcatggtggcgcatgcctataatcctagctactcaggcagctgaagcaggagaattgcttgaacccgggaggcagaggttgcagtgagccaagatcatgccactacactccagcctgggcgacagagcgacactctgcctcaaaaaaaaaaaaaaacaaaaaaaaaaacaagttttgtgaatttaagtttccctaatggatggtacaggtcaacatttgccatctaatgacacttacattccagttttttccttttttgagtaactgggaaaagggtggcattactgctggcttcctaaaattgaaaagtatactagggtttttaaacctgtgtagaatacatgatatggtagcaaatgtgctgtaggaagaaaagcaatgaggaactactggcctgactaggaggcctagaagtccctcccaggcttgagttgttctgacttggcatgattacatagctgcggcaagtgacgtttccttcaagccttggttccctcatctgtaaaatagggaactaatacctacctcacaggattgtagttagaattaaggatgacttcattaaagcacctctagtggtggaagatgtcccatcctatcccccacccatagctgggagctatgtttggctcattcttcctgactcactggattacactgtgactcagttcaatttcacacatgctgctgctaaattagggtcttggtgagcctttgggaggacagctctgaggaatgaattgtagcactgcagccctgcctgaggaacatgatagaaacaggtggtaggcccagctcttgccttccacctactaagcagtttttctgtggttagctgtgtgacataaactatcggtgtattaatttgctttcactagattcccccccccccaacaacttagtccaagaacatacctgaattctttgcatttccttgccttagttgcttttgtagggtggacagcaggactgcatgagaatagctgtgcttctggaccctatggtgaaagctctagtgaactgcaattaggcccagggtcccggaggaagaaggggagagaaaaaggggggtagttttccaaaagataagtaggggacaaaaaagtccacggggcctatgagcggtgagactcctgccctgattgtggcaaagcacctggagatgatagaacttcctagggaaaaggctgcatggagtccccagggatgctgggccctggtcaccaaggctccctgggaaggtctcttgtacctggggcacacagaccaacacttctgaatttgcaagcttaagagcatgtatgagcagaacctgtgcagaccaaggcttagagggctcacctcaatgttttgcactgtgtgagaccccaggaccttttcgtgattctggagaggggaacaaaccataataacaacaaaccaggtagcaggatagagactcattctcatctattttggttaaaagaaaataaatgtatttcttccacacctgattttgtgattgcaaattcataactaatatccctcgtcagctccgctgactcatccctgccacagggaggttcacagcaagagcacagaaactagggccagtgcccggttgtgtgaccttgagtaagttctttttcccttgaacagggagagagacacaatggatcagagtgtctctgccagttctaacttggggattctagtgggttgaaccgaacggtagtccgtttccaaaagaggaagccaagaccagagggggagtggttccttcaagtttgcagaaccagtaagtggcagagcaggactcatatctagttagtggttcagagcatgggctccggagctagactgcctggatttgaaccctggctttgccacttgcctgttgggtgactttggacaagctgcttaaattatgtctccatttcctaatccacagaacaagtgtaatactagttatctgtttcatggagtgattgtgaggattaaataaagttaatataacacaaagca

SEQ ID NO: 142553 - DNA, 609 bp, Homo sapiens
  Payload ID: 8167
  Gene Symbol: IPO9
  Gene Name: importin 9
  ENST ID: ENST00000456707
  CDS Start-End: 1-468
tccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaagga

SEQ ID NO: 142554 - DNA, 1585 bp, Homo sapiens
  Payload ID: 8168
  Gene Symbol: INADL
  Gene Name: InaD-like (Drosophila)
  ENST ID: ENST00000307297
  CDS Start-End: 79-1437
agtctgtggtgaggatttgagctgcgtccagcattggatatttgtcaggaatgcagataccctgaagggaacacaacaatggtccaagggggtttcccagaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgttctggaggctgggaagtccaagagcatggagccagcatctggtgagggccttcatgctgcatcatcctgtgacagaagttgaagggcaaaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcaggttgtcgatggcttctcatcagactgactcactcttctgcccccactgggagaaagttccccatttaataaatggttgtttggaaataatatctaatgtacagcatattcacagcaccaagtttagtgaactttcatgtgtttgaaataaaaatgaaaggtgggatggaaattca

SEQ ID NO: 142555 - DNA, 3657 bp, Homo sapiens
  Payload ID: 8168
  Gene Symbol: INADL
  Gene Name: InaD-like (Drosophila)
  Uniprot ID: Q8NI35
  ENST ID: ENST00000316485
  CDS Start-End: 115-3657
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccaccctggacgacagagcgagactctgtctcaaaaaaaaaaaaaagaaaagaaaga

SEQ ID NO: 142556 - DNA, 8505 bp, Homo sapiens
  Payload ID: 8168
  Gene Symbol: INADL
  Gene Name: InaD-like (Drosophila)
  Uniprot ID: Q8NI35
  ENST ID: ENST00000371158
  CDS Start-End: 115-5520
ctcacttccgcccaggtgaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttttttgagacggagtctcactctgtcacccaggctggagtgcaatggcgcaatcttggctcactgcaacctcggcctcccaggttggagcgattctcctgcctcagcctcccgagtagctgggattacaggcatgcatcaccacactgggtttatttttgtttttttagtagagatggagcttccccatgtgggccaggctggtcttgaacttctgacctcaggtgatctgcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaa

SEQ ID NO: 142557 - DNA, 4990 bp, Homo sapiens
  Payload ID: 8168
  Gene Symbol: INADL
  Gene Name: InaD-like (Drosophila)
  Uniprot ID: Q8NI35
  ENST ID: ENST00000484937
  CDS Start-End: 13-3417
gattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagaaacacctccacctaagattattactttggagaaaggctctgaaggcttggggtttagtattgtagggggttatggaagtccccatggagacctgccaatttatgtcaagactgtatttgcaaagggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttttttgagacggagtctcactctgtcacccaggctggagttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataa

SEQ ID NO: 142558 - DNA, 4172 bp, Homo sapiens
  Payload ID: 8168
  Gene Symbol: INADL
  Gene Name: InaD-like (Drosophila)
  ENST ID: ENST00000613764
  CDS Start-End: 98-3646
gaggcagggccgacaccgagcccgcccgacccgggctcccacctgctcctccagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggcttctggagtagataaagaattgtgtaatcagtttgtgtccccagctgagggcaggaaaattgctacctgggaggtgtgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgag

SEQ ID NO: 142559 - DNA, 569 bp, Homo sapiens
  Payload ID: 8168
  Gene Symbol: INADL
  Gene Name: InaD-like (Drosophila)
  ENST ID: ENST00000465798
  CDS Start-End: 1-419
aagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcaggttgtcgatggcttctcatcagactgactcactcttctgcccccactgggagaaagttccccatttaataaatggttgtttggaaataatatctaatgtacagcatattcacagcaccaagtttagtgaactttcatgtgtttgaaataaaaatgaaaggtgggatggaaattcatt

SEQ ID NO: 142560 - DNA, 2298 bp, Homo sapiens
  Payload ID: 8168
  Gene Symbol: INADL
  Gene Name: InaD-like (Drosophila)
  ENST ID: ENST00000635137
  CDS Start-End: 316-2097
atccaagggtctgatgtgggaaaccagggattttgcttctccggcatagttttccaggcagctttcacctgctgacagaggtgactgtttagcttgaggactagcttgaaattagcttaattgattgcttttcctgatataaatagattgacaggttgcccttaaagagaacaaaatctgagagagagagagagagagagagagaaaaataggcccaaggtcgtcagaagagagaggagtctgtggtgaggatttgagctgcgtccagcattggatatttgtcaggaatgcagataccctgaagggaacacaacaatggtccaagggggtttcccagaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctggacctccgcaaggacgacatcacagaacagtcagggtagtcagcagagtgcacacagcagctgtcatccctccttcgctcctgtcatcactggcctgcaaaacctggttggcacaaaaagagtttcagatccttcccagaaaaattcaggcacagatatggaaccaaggactgttgagataaacagggagctcagtgatgcccttggaatcagtattgctggaggaagaggaagtcccttaggagatatccccgtatttattgccatgattcaggctagcggagtggccgcacggacacagaagcttaaagttggagatcggattgtcagcattaacgggcaacctttggatgggctgtctcacgcggatgtggttaatctgctgaagaacgcctacgggcgcattatcctgcaggttgtagcagataccaatataagcgccatagcagctcagcttgaaaacatgtctacaggctaccaccttggttcgcccactgctgaacaccatccagaagacacagagagatgctgtaattgcccaatggattcaccttgcccactgctgttggggtgatcagacccaacaccaggtcatggggacgacgaagtccggcggagtcaaaggaatgattaaaaagacagtttgagagaagtgggcccagggggccatcgtgtgaggctgcgaaggccccaagctctgggagcccacgctatttattggtgctcaaagaaacaggtggtgaggatgtggggtttgaaaagaaacagtgtatca

SEQ ID NO: 142561 - DNA, 701 bp, Homo sapiens
  Payload ID: 8168
  Gene Symbol: INADL
  Gene Name: InaD-like (Drosophila)
  ENST ID: ENST00000494842
  CDS Start-End: 1-439
tgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagactctgactcagaatagaatttacagtcatccataattttacttgcctaataataactactgccacagctggccaggtgcaacaggaagaccatcgccatcaactctttcttccaaaccttggttgcttctccccacttaaaacctgtttctgcaaagaagtcacttccaggattacttttcttttcttgttcttttataatatagcaccacgaatgggacccacattgggtcgtaacactgactagcataatcattacataaataaagtcaaagatgaccttatgtaaccaatatta

SEQ ID NO: 142562 - DNA, 5242 bp, Homo sapiens
  Payload ID: 8168
  Gene Symbol: INADL
  Gene Name: InaD-like (Drosophila)
  ENST ID: ENST00000635023
  CDS Start-End: 47-2098
cagcgcaccaggtgtctttaagagtgattgaagagaataattcaaaatgcctgaaaatcctgctacagataaactgcaggtgctgcaggtacttgatcgcctgaaaatgaaattgcaggagaagggtgacacgtcgcagaatgagaagttatctatgttttatgagacactaaagagtcctctcttcaaccagatactcacacttcagcagtccatcaagcaactgaagggtcaactcaaccatataccctcagattgttcagccaactttgatttttctaggaaaggtttgttagtgttcacagatggttccatcactaatggaaatgtccacaggccctctaataactcgactgtatctgggttatttccgtggaccccgaagttgggaaatgaagactttaactcagtcattcaacagatggctcagggccggcaaattgaatatatagatatagaacggccttcaactggaggccttggattcagtgtggtggccctcagaagtcaaaatctcggaaaagttgatatcttcgtgaaggatgtccagccagggagtgtagcagacagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttcctggaggattagcagatcgagatggaagactccagacaggggaccacatcttgaagattggtggcacaaacgtgcagggaatgaccagtgagcaagttgcacaagttctaaggaactgtgggaattcagtcaggatgctcgttgctagagatccagctggtgacatttcagtcaccccccctgcccctgcagccttacctgttgccctgcctactgtagccagcaagggccctggttctgacagttctctttttgaaacttataatgttgagcttgtgagaaaagatgggcagagtcttggaattagaattgttggctatgttggaacatctcatacaggggaagcttcagggatttatgtgaaaagtataatacctggcagtgctgcgtaccacaatggccacattcaagtgaatgacaaaatagttgctgtcgatggcgtgaacattcagggttttgccaaccatgatgttgttgaagtattacgaaatgcagggcaggtggtacacctaaccctagttcgaaggaagacatcctcatctacttctccacttgaaccaccttcagacagaggaactgttgtagaaccactgaaaccaccagctctctttctaactggagcagtggaaactgaaactaatgtggatggtgaagatgaggaaattaaagaaagaattgatactttaaaaaatgacaacatacaagccttagaaaaattggaaaaagtcccagactctccagaaaatgagctgaaatccagatgggaaaacctgttgggtcctgattatgaagtaatggttgctactttggacacacagattgcagatgatgctgagttacagaaatattcaaagctgctgcctattcacactctgaggcttggtgtggaagtggattcctttgatgggcaccattatatttcttcaattgtttctggtggtcctgttgatacattgggtctcctacagccagaagatgagctgcttgaggtcaatggcatgcagctttatggaaaatctcgccgagaagcagtctcctttcttaaagaagtgccacccccttttactttggtttgctgtcggaggttgtttgatgatgaagcttctgtagatgaaccaaggcgcactgaaacctctcttcctgagacagagaactcattgaagtataagaggttgaccacaatatggatgtcaatactgaagaagatgatgatggggaattagcactgtggtcccctgaagtcaagattgttgaactagtaaaagattgtaaaggtttgggattcagcattttggattaccaggaccctttagatcctacaagatcagtgattgtgatccgctccctggtagcagatggtgtagcagaaagaagtgggggactattacctggagaccgcctggtctcagtcaatgaatactgtttggacaacacctcacttgctgaagctgtggaaatattgaaagctgtgccaccaggcctagtacaccttggcatctgtaagcctttggtggaagataatgaagaagaaagttgttatattttacattcaagcagtaatgaagacaagactgaattttcaggaacaattcatgatataaattcatctttaatactcgaagcacccaagggatttagagatgaaccatattttaaagaagaacttgtggatgaaccatttctagatctgggaaagtctttccattcccaacaaaaagagatagagcaaagcaaggaggcctgggagatgcatgaatttctgactcctagattgcaggaaatggatgaagaaagagaaattcttgttgatgaagaatatgagttatatcaagatccctcaccatccatggagttgtatcccttgtcgcacattcaagaggccactcctgtgccctctgtgaatgaacttcactttggtacacagtggttgcatgataatgaaccatccgagtctcaagaggcaagaaccgggaggactgtctattcccaggaggcacagccgtatggctattgccctgaaaatgtgatgaaagaaaattttgtcatggagtccctaccatctgtaccatcaactgaaggaaacagtcaacaaggcagatttgacgacctggaaaatcttaattcattagcaaaaactagtctggatttaggcatgatcccgaatgatgtccaaggtcctagcttgctcattgaccttcctgttgtggctcaaaggagggagcaagaagatttgcctttatatcaacaccaagcgacacgagttatttccaaggcctcagcatacacaggaatgttgtcttctagatatgccactgatacatgtgagttacctgagagagaagaaggcgaaggagaagaaactccaaattttagccactggggtccaccgagaattgttgagatttttagagaacccaatgtgtctcttgggatcagtattgttggtggacaaactgttataaaacgtctaaagaatggagaggagcttaaaggtatattcatcaaacaagttttagaagacagtccagcagggaagacgaacgcacttaaaactggagataaaatacttgaggtgtctggagtagatttgcagaatgcctcacacagcgaagcagttgaggccattaagaatgcaggaaaccctgtggtgttcattgttcagagtttgtcatccactccacgagtcattcctaacgtacataacaaggccaacaaaatcaccggtaaccagaaccaggacacccaagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagagataaacaatcagattctgtatggaagaagtcaccaaaatgcatctgccattattaagactgccccatcaaaggtcaagctggttttcatcagaaacgaggatgcagtcaatcagatggccgttactccctttccagtgccatcaagttctccatcttctattgaggatcagagcggcaccgaacctattagtagtgaggaagatggcagcgtcgaagttggtattaaacaattgcctgaaagtgaaagcttcaaactggctgtcagccagatgaaacagcaaaaatatccaacaaaagtctccttcagttcacaagagataccattagcaccagcttcatcataccattcaacagatgcagacttcacaggctatggtggtttccaggctcctctgtcagtggaccccgcaacgtgtcccattgtccctggacaggaaatgattatagaaatatccaagggacgttcagggcttggtctcagcattgtgggaggaaaagacacacccttgaatgctatagttatccatgaagtctatgaagaaggggcagcagccagagatggaagactttgggctggtgaccagatattagaggttaatggggttgacctgaggaactccagccacgaagaagccatcacagccctgaggcagaccccccagaaggtgcggctggtggtgtatagagatgaggcacactaccgggatgaggagaacttggagattttccctgtggatctgcagaagaaagctggccggggcctgggcctgagcatcgttgggaaacggtaaagacgtgctgtgggagttgggatctgcctttttcatccagagctctgatgcctgtgaacactgaaagagaaagcctaatgtaaagtagtgatgggatttctaaaaataagatatttatgaaaatttgacaacatgggtcatatttctgagcaaggtcttaccagaaaaattgtcatatcaagatagaactccaagtccaatcaatccagactgatatatttctgtacagagtaagaacaactagcaaggttctttcacttggaattactaagatcggagttttgcagaggttgattaaagcaaccatacccaagaaatagctagcatcaagaatgagatttatccaatgttgggtcaagaacattgcttcgacatggaaattaacatggaacattgcttttcgtgatactgttaatttcatactatgttgaaactagttgagtagacatagttaagagataaacataattcttcacgatagtagttttctattaagaaaaatgtcctgctgggcaca

SEQ ID NO: 142563 - DNA, 387 bp, Homo sapiens
  Payload ID: 8168
  Gene Symbol: INADL
  Gene Name: InaD-like (Drosophila)
  ENST ID: ENST00000490547
  CDS Start-End: 1-336
caagaaaagaaagaaaagaggcaaggaactgctccaccgccaatgaaacttcctcctccttataaagctctgactgatgacagtgatgaaaatgaagaagaagatgcctttaccgaccaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctgctgccgcagatggacgaatgcgtattggagatgaactcttagaggtgagaagcatgtgtttttaacttatcttttggtgaagtggatgggtgcagtggatgttgtataggaaaatg

SEQ ID NO: 142564 - DNA, 1255 bp, Homo sapiens
  Payload ID: 8169
  Gene Symbol: INAFM1
  Gene Name: InaF-motif containing 1
  Uniprot ID: C9JVW0
  ENST ID: ENST00000552360
  CDS Start-End: 468-896
gccgtagcgggcagggctcgagcactggagtagagcagtccgacaggtagagaagtgagactggctgcggcacagggcgggttagggctccaggcagggcttgagcgggacgagggggcgggctccgaggcgggctagatgcctgggctggatgaagtccgagtctgggaagagaaccgtgttgtggcgggaggaggcggtgattggggtggtggggctaagcgcgggggcggggctggagcgaggggggcggggtagcacctccgcctgtcggtggtggggcggaggctggagggggtgggcctaggatgcggaggcggcagctcgcgtgggggcgtgaccatgctggcgggggcggggccggaggcgggcggtttagagagcggggcggtctgcggggtgggggcggggcctggtgggggcggggcctgtgcggtctgcggcgcggagccgagtgggctgcggggatgcgggggaccagctgcgtgggcggcggcgccgagagccccggaggcgcggggctgagcgagggcccgcgggggcgctggctgcgcttggctccggtatgcgcctacttcctctgcgtctcgctagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggctgcctcgtgctgtgtc

SEQ ID NO: 142565 - DNA, 2356 bp, Homo sapiens
  Payload ID: 8170
  Gene Symbol: IST1
  Gene Name: increased sodium tolerance 1 homolog (yeast)
  Uniprot ID: P53990
  ENST ID: ENST00000329908
  CDS Start-End: 63-1145
gaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctg

SEQ ID NO: 142566 - DNA, 2255 bp, Homo sapiens
  Payload ID: 8170
  Gene Symbol: IST1
  Gene Name: increased sodium tolerance 1 homolog (yeast)
  Uniprot ID: P53990
  ENST ID: ENST00000378798
  CDS Start-End: 53-1060
gtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccagtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcc

SEQ ID NO: 142567 - DNA, 4843 bp, Homo sapiens
  Payload ID: 8170
  Gene Symbol: IST1
  Gene Name: increased sodium tolerance 1 homolog (yeast)
  Uniprot ID: P53990
  ENST ID: ENST00000378799
  CDS Start-End: 357-1457
ctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctgctttctctactgtttggtcagatgatgaagtataaatctggattttagtggagaatattttaaccaagtgatccatgtaaaccagcccttagtttcaggattcctggagcagtacagagctcattttgatctctgtatttagatagcccagatagcatctgtgaatttccttggtcttcctcagtggcagggctccgcatctgccatgcctcatccttggatgtttatttttagtaagttgcagtgagctcacttctgactgcttcatttcccgcagccatcctgggccatgggtggtgagttctgttacttgctgcttggcagcagagctagtttgtctcgtagtattcttgcattgttaatcctatcttgacagtgccaagatccataagaacttgggaccaaggggattttgattcctaacttacagaattaaaaacaaagtatattataattttaaagctatgccatgcaaagataagtagtaatacgctaataaatactaagccaagtaggagataacaggattaaggtagttcatctaaaacttcagtgtcactgcccactgctgtcgtggctgcttgctcagatgaggttttttggggccaactgattcctaacaaatttgagagcttctgtagcagtgtatctattagtgcagcttctttctgagtattgaagacaaaaagagaaaagtgagaaaattgaaattactgctaatagtggagtaaaaaaagtaccaaagatttttaaaaaattagtaaatgtaaagatactatttctttaataatttgcagtcaggcattggagtgtttccactaatggttgcgagccaactatttataggacaatggctatagaatattatgtagtcttataaattgggtttcctaggaagatagctggcagagcttttgaaactaataaagggaatatgatactgtgcattataaattatgtcagcccgtcatcttaggggcagttacagtggagctttcccagtgatataacagcatgctagtttatcttttagttacctaccttaagcgactttctttcttttccaaaggccatgagaatggccgaaacgaaaagattaattaccacaagtaccatcaagatgacactggtgaggatcagaaaggtgcccaggactgggtctaaagcgaaaacctgggaaaacaataagaacacttgcagtgactgacaatttagtttatactttacaaacataagctatatgctagtgtttgggatcttatcagaagaaaagcttatccgaaggaaacttagggagagagtcaaaagataataagaaggaaaatacttttaaatggacagaagagcaggaatgactcattttaaggaggttaagataattgtgactgcagggctttcacaagaaaacaggtgagttgcagtggaattggaaatgattcaaatgtcacatgagttttggcaaaaaatacatctaatcatggaagctaaaagtgggaggggggtaagcaaacactgaaagattaaatgcataccagaaatgagaatgcacactgtctctgccatatcaagaaactacaaccctaaacacaggagcattccaataaaagttaacaggttggccacagaaaactggctttttagtatttttttttttccattgtcatttttaaaggtacaagcattgagttctgccattctttacttttctgcatacataaatatcaagttctgggcttattggaatggttcccataacaaaaactgttgtttaaaatttagatgttctttttcaacaaatggtatttattttcccttggtattggcccattcattgttgccactagggcactgtttaaaaatatcccaacagaggggttgattacagtcaatgccaccctgatggaaatctatatggcaaaatattttcaagcaccaaactgttttacctacttaaaaatgattattataacaatttcaggtcaaccagataatgtgggcaatctctgagtttgtgatacaagacttatttccaataagtttatttttatgtacaattttactgtttattttttgtttgctctatttgttttttaatgttttttactttatgtttactgtatttttatgtacaattacatccaaagcagaaaagttccttttttatccccaaaaggaggtgtcagcaaaaa

SEQ ID NO: 142568 - DNA, 521 bp, Homo sapiens
  Payload ID: 8170
  Gene Symbol: IST1
  Gene Name: increased sodium tolerance 1 homolog (yeast)
  ENST ID: ENST00000424485
  CDS Start-End: 98-521
gtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatactctgtgccaagtatagcaaggaatatggcaagctatgtaggaccaaccagattggaactgtgaatg

SEQ ID NO: 142569 - DNA, 1841 bp, Homo sapiens
  Payload ID: 8170
  Gene Symbol: IST1
  Gene Name: increased sodium tolerance 1 homolog (yeast)
  ENST ID: ENST00000439924
  CDS Start-End: 16-141
gaggaacagcacagcatgctgggctctggatttaaagctgagcgcttaagagtgaatttgagattagtcataaatcgccttaaactattggagaaaaagaaaagcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcct

SEQ ID NO: 142570 - DNA, 2031 bp, Homo sapiens
  Payload ID: 8170
  Gene Symbol: IST1
  Gene Name: increased sodium tolerance 1 homolog (yeast)
  ENST ID: ENST00000456820
  CDS Start-End: 1-870
gactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtaagtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctc

SEQ ID NO: 142571 - DNA, 4082 bp, Homo sapiens
  Payload ID: 8170
  Gene Symbol: IST1
  Gene Name: increased sodium tolerance 1 homolog (yeast)
  Uniprot ID: P53990
  ENST ID: ENST00000535424
  CDS Start-End: 117-1256
agcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctgctttctctactgtttggtcagatgatgaagtataaatctggattttagtggagaatattttaaccaagtgatccatgtaaaccagcccttagtttcaggattcctggagcagtacagagctcattttgatctctgtatttagatagcccagatagcatctgtgaatttccttggtcttcctcagtggcagggctccgcatctgccatgcctcatccttggatgtttatttttagtaagttgcagtgagctcacttctgactgcttcatttcccgcagccatcctgggccatgggtggtgagttctgttacttgctgcttggcagcagagctagtttgtctcgtagtattcttgcattgttaatcctatcttgacagtgccaagatccataagaacttgggaccaaggggattttgattcctaacttacagaattaaaaacaaagtatattataattttaaagctatgccatgcaaagataagtagtaatacgctaataaatactaagccaagtaggagataacaggattaaggtagttcatctaaaacttcagtgtcactgcccactgctgtcgtggctgcttgctcagatgaggttttttggggccaactgattcctaacaaatttgagagcttctgtagcagtgtatctattagtgcagcttctttctgagtattgaagacaaaaagagaaaagtgagaaaattgaaattactgctaatagtggagtaaaaaaagtaccaaagatttttaaaaaattagtaaatgtaaagatactatttctttaataatttgcagtcaggcattggagtgtttccactaatggttgcgagccaactatttataggacaatggctatagaatattatgtagtcttataaattgggtttcctaggaagatagctggcagagcttttgaaactaataaagggaatatgatactgtgcattataaattatgtcagcccgtcatcttaggggcagttacagtggagctttcccagtgatataacagcatgctagtttatcttttagttacctaccttaagcgactttctttcttttccaaaggccatgagaatggccgaaacgaaaagattaattaccacaagtaccatcaagatgacactggtgaggatcagaaaggtgcccaggactgggtctaaagcgaaaacctgggaaaacaataagaacacttgcagtgactgacaatttagtttatactttacaaacataagctatatgctagtgtttgggatcttatcagaagaaaagcttatccgaaggaaacttagggagagagtcaaaagataataagaaggaaaatacttttaaatggacagaagagcaggaatgactcattttaaggaggttaagataattgtgactgcagggctttcacaagaaaacaggtgagttgcagtggaattggaaatgattcaaatgtcacatgagttttggcaaaaaatacatctaatcatggaagctaaaagtgggaggggggtaagcaaacactgaaagattaaatgcataccagaaatgagaatgcacactgtctctgccatatcaagaaactacaaccctaaacacaggagcattccaataaaagttaacaggttggccacagaaaa

SEQ ID NO: 142572 - DNA, 674 bp, Homo sapiens
  Payload ID: 8170
  Gene Symbol: IST1
  Gene Name: increased sodium tolerance 1 homolog (yeast)
  ENST ID: ENST00000534994
  CDS Start-End: 56-674
gtcggtgtctgctgcgttcacggcaggattcggttaggtgagtgaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaag

SEQ ID NO: 142573 - DNA, 476 bp, Homo sapiens
  Payload ID: 8170
  Gene Symbol: IST1
  Gene Name: increased sodium tolerance 1 homolog (yeast)
  ENST ID: ENST00000540296
  CDS Start-End: 298-476
ttcctctcttctagaatgcctgagcctgccctggcatcgcttacctggagaagcagggaatgcagaggaaagaagatgagatctggtattagaagatctggctttgagccccagctctgccacccaccagcctgttgactttggcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattat

SEQ ID NO: 142574 - DNA, 531 bp, Homo sapiens
  Payload ID: 8170
  Gene Symbol: IST1
  Gene Name: increased sodium tolerance 1 homolog (yeast)
  ENST ID: ENST00000538104
  CDS Start-End: 412-531
accatgcgtaatttcctctttagtagagacggggttcctctgtgttggccaggctggtctcgaattaccgacttcagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaagagaatggggtcttgctacattgtccaagctggtctcaaactcctggcctcaagtgatcctctccccttggcctcccaaagtgctggaattacagagacgaggtcttactgtgttactcaggctggtcccttggcctcaaacgatccttctacctcagcctctcaagtagctgaggttataggaggaacagcacagcatgctgggctctggatttaaagctgagcgcttaagagtgaatttgagattagtcataaatcgccttaaactattggagaaaaagaaaacggaactggcccagaaagcaaggaaggagatt

SEQ ID NO: 142575 - DNA, 542 bp, Homo sapiens
  Payload ID: 8170
  Gene Symbol: IST1
  Gene Name: increased sodium tolerance 1 homolog (yeast)
  ENST ID: ENST00000539186
  CDS Start-End: 44-542
ggtgagtgtggcatcctcggcgtcagaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctga

SEQ ID NO: 142576 - DNA, 908 bp, Homo sapiens
  Payload ID: 8170
  Gene Symbol: IST1
  Gene Name: increased sodium tolerance 1 homolog (yeast)
  ENST ID: ENST00000541918
  CDS Start-End: 149-908
aagtcggtgtctgctgcgttcacggcaggattcggttagagaatggggtcttgctacattgtccaagctggtctcaaactcctggcctcaagtgatcctctccccttggcctcccaaagtgctggaattacaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccag

SEQ ID NO: 142577 - DNA, 1962 bp, Homo sapiens
  Payload ID: 8170
  Gene Symbol: IST1
  Gene Name: increased sodium tolerance 1 homolog (yeast)
  Uniprot ID: P53990
  ENST ID: ENST00000541571
  CDS Start-End: 702-1802
ttttttcttttttttgtattttttttagtagagacgagatttcacaatgttggtcaggctggtcttgaactcctgacctcaggtgatccacctgcctcagtctccccaagtgctgggattacaggcatgtgccaccgcgcctggcatggaacctggttttatcttgaaatgttgcaaacgtttataaagatacagtatttctaaattcacatcaacatcttatgataagggctagctcctacttgtcatatgactgccccggtacaagcattagatgcagcctccacagcagggagcagatgacttccttctggaggcccctttttcttttttccctttttttttttgagacgtttcgctcttgttgcccaggctggagggcaatcgccggatctcggctcactgtaactcgagaatcaagcgattctcctgcctcagcctccggagtagctgggattacaggcttgcgccaccatgcgtaatttcctctttagtagagacggggttcctctgtgttggccaggctggtctcgaattaccgacttcagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgcttt

SEQ ID NO: 142578 - DNA, 503 bp, Homo sapiens
  Payload ID: 8170
  Gene Symbol: IST1
  Gene Name: increased sodium tolerance 1 homolog (yeast)
  ENST ID: ENST00000568581
  CDS Start-End: 187-503
ggggggcgctgggtgtggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggc

SEQ ID NO: 142579 - DNA, 894 bp, Homo sapiens
  Payload ID: 8170
  Gene Symbol: IST1
  Gene Name: increased sodium tolerance 1 homolog (yeast)
  ENST ID: ENST00000537613
  CDS Start-End: 136-894
cgcccgcgcttgttgtgctgaggccgagggagtcgccattttggatggtgaaccctgaagtcggtgtctgctgcgttcacggcaggattcggttagtcattgtgcttcttctgtttctaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggacca

SEQ ID NO: 142580 - DNA, 1500 bp, Homo sapiens
  Payload ID: 8170
  Gene Symbol: IST1
  Gene Name: increased sodium tolerance 1 homolog (yeast)
  Uniprot ID: P53990
  ENST ID: ENST00000544564
  CDS Start-End: 323-1423
tagagacagattttcgcaatgttgaccaggctggtctcgaactcctgacctcaagtgatccccctgccttaccctcccaaaatgctgggattacagagatactgtttcgaataattggcttgttggggtacaattcacagttgatatattacaggatctaaatagacagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatg

SEQ ID NO: 142581 - DNA, 1125 bp, Homo sapiens
  Payload ID: 8170
  Gene Symbol: IST1
  Gene Name: increased sodium tolerance 1 homolog (yeast)
  Uniprot ID: P53990
  ENST ID: ENST00000538850
  CDS Start-End: 130-786
ctgaagtcggtgtctgctgcgttcacggcaggattcggttaggttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaa

SEQ ID NO: 142582 - DNA, 823 bp, Homo sapiens
  Payload ID: 8170
  Gene Symbol: IST1
  Gene Name: increased sodium tolerance 1 homolog (yeast)
  ENST ID: ENST00000536027
  CDS Start-End: 1-258
atgcctatgccatctgcaaatacgcctttctcatatccactgccaaagggaccatcagatttcaatggactgccaatggggacttatcaggcctttcccaatattcatccacctcagataccagcaactcccccatcgtatgaatctctgatgtgttctaccttgggcctgagtttttcttatgctttggttttgcatgcgtcacataacccacagccgttggtaggaatgaggtcgaaaatcttcatcagtatttgaggacttggttcttaagatatattcaagaatgctttccctttgcccaaaggtgaaagtatcattaaagttgtcttagtatggtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgt

SEQ ID NO: 142583 - DNA, 3583 bp, Homo sapiens
  Payload ID: 8170
  Gene Symbol: IST1
  Gene Name: increased sodium tolerance 1 homolog (yeast)
  Uniprot ID: P53990
  ENST ID: ENST00000606369
  CDS Start-End: 101-757
ccgcccgcgcttgttgtgctgaggccgagggagtcgccattttggatggtgaaccctgaagtcggtgtctgctgcgttcacggcaggattcggttagctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctgctttctctactgtttggtcagatgatgaagtataaatctggattttagtggagaatattttaaccaagtgatccatgtaaaccagcccttagtttcaggattcctggagcagtacagagctcattttgatctctgtatttagatagcccagatagcatctgtgaatttccttggtcttcctcagtggcagggctccgcatctgccatgcctcatccttggatgtttatttttagtaagttgcagtgagctcacttctgactgcttcatttcccgcagccatcctgggccatgggtggtgagttctgttacttgctgcttggcagcagagctagtttgtctcgtagtattcttgcattgttaatcctatcttgacagtgccaagatccataagaacttgggaccaaggggattttgattcctaacttacagaattaaaaacaaagtatattataattttaaagctatgccatgcaaagataagtagtaatacgctaataaatactaagccaagtaggagataacaggattaaggtagttcatctaaaacttcagtgtcactgcccactgctgtcgtggctgcttgctcagatgaggttttttggggccaactgattcctaacaaatttgagagcttctgtagcagtgtatctattagtgcagcttctttctgagtattgaagacaaaaagagaaaagtgagaaaattgaaattactgctaatagtggagtaaaaaaagtaccaaagatttttaaaaaattagtaaatgtaaagatactatttctttaataatttgcagtcaggcattggagtgtttccactaatggttgcgagccaactatttataggacaatggctatagaatattatgtagtcttataaattgggtttcctaggaagatagctggcagagcttttgaaactaataaagggaatatgatactgtgcattataaattatgtcagcccgtcatcttaggggcagttacagtggagctttcccagtgatataacagcatgctagtttatcttttagttacctaccttaagcgactttctttcttttccaaaggccatgagaatggccgaaacgaaaagattaattaccacaagtaccatcaagatgacactggtgaggatcagaaaggtgcccaggactgggtctaaagcgaaaacctgggaaaacaataagaacacttgcagtgactgacaatttagtttatactttacaaacataagctatatgctagtgtttgggatcttatcagaagaaaagcttatccgaaggaaacttagggagagagtcaaaagataataagaaggaaaatacttttaaatggacagaagagcaggaatgactcattttaaggaggttaagataattgtgactgcagggctttcacaagaaaacaggtgagttgcagtggaattggaaatgattcaaatgtcacatgagttttggcaaaaaatacatctaatcatggaagctaaaagtgggaggggggtaagcaaacactgaaagattaaatgcataccagaaatgagaatgcacactgtctctgccatatcaagaaactacaaccctaaacacaggagcattccaataaaagttaacaggttggccacagaaaa

SEQ ID NO: 142584 - DNA, 126 bp, Homo sapiens
  Payload ID: 8170
  Gene Symbol: IST1
  Gene Name: increased sodium tolerance 1 homolog (yeast)
  ENST ID: ENST00000626438
  CDS Start-End: 1-126
atgctgggctctggatttaaagctgagcgcttaagagtgaatttgagattagtcataaatcgccttaaactattggagaaaaagaaaagcagaagctcctcctggggtagagacagatcttattga

SEQ ID NO: 142585 - DNA, 2023 bp, Homo sapiens
  Payload ID: 8171
  Gene Symbol: IHH
  Gene Name: indian hedgehog
  Uniprot ID: Q14623
  ENST ID: ENST00000295731
  CDS Start-End: 1-1236
atgtctcccgcccggctccggccccgactgcacttctgcctggtcctgttgctgctgctggtggtgccggcggcatggggctgcgggccgggtcgggtggtgggcagccgccggcgaccgccacgcaaactcgtgccgctcgcctacaagcagttcagccccaatgtgcccgagaagaccctgggcgccagcggacgctatgaaggcaagatcgctcgcagctccgagcgcttcaaggagctcacccccaattacaatccagacatcatcttcaaggacgaggagaacacaggcgccgaccgcctcatgacccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgagcactcggccgcagccaagacgggcggctgcttccctgccggagcccaggtacgcctggagagtggggcgcgtgtggccttgtcagccgtgaggccgggagaccgtgtgctggccatgggggaggatgggagccccaccttcagcgatgtgctcattttcctggaccgcgagcctcacaggctgagagccttccaggtcatcgagactcaggaccccccacgccgcctggcactcacacccgctcacctgctctttacggctgacaatcacacggagccggcagcccgcttccgggccacatttgccagccacgtgcagcctggccagtacgtgctggtggctggggtgccaggcctgcagcctgcccgcgtggcagctgtctctacacacgtggccctcggggcctacgccccgctcacaaagcatgggacactggtggtggaggatgtggtggcatcctgcttcgcggccgtggctgaccaccacctggctcagttggccttctggcccctgagactctttcacagcttggcatggggcagctggactccgggggagggtgtgcattggtacccccagctgctctaccgcctggggcgtctcctgctagaagagggcagcttccacccactgggcatgtccggggcagggagctgaaaggactccaccgctgccctcctggaactgctgtactgggtccagaagcctctcagccaggagggagctggccctggaagggacctgagctgggggacactggctcctgccatctcctctgccatgaagatacaccattgagacttgactgggcaacaccagcgtcccccacccccgtcgtggtgtagtcatagagctgcaagctgagctggcgaggggatggttgttgacccctctctcctagagaccttgaggctggcacggcgactcccaactcagcctgctctcactacgagttttcatactctgcctcccccattggggagggcccattccatccatcttaggcccctttgggtgggcttgcgcctcagttgatgctgctaaattccctgggagccagcatggatctggctggacccgatgctgtccagaactgggaaggccacaggggtggggcagccatcccggccattctgaggtatgacattcctccccggccacactcctcaagacacatccagagactgttgctgtctgtgggcagagttctgtgttctggccaatgtgaccgtagtgccggggactgggggaggtgggttggatgtgcttgccacccccccggctaagctcccccttctgctgaaccatgatccccaccccctccgccggtcagtctcccataccttatttattggagtggagggggaagcccatgggagaattttggggatgttttggtcttttcttccttttgtaataaaaattatttaagttgttagagcca

SEQ ID NO: 142586 - DNA, 1525 bp, Homo sapiens
  Payload ID: 8172
  Gene Symbol: IDO1
  Gene Name: indoleamine 2,3-dioxygenase 1
  ENST ID: ENST00000253513
  CDS Start-End: 55-567
atgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacggcaaatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaatgcataagatata

SEQ ID NO: 142587 - DNA, 1138 bp, Homo sapiens
  Payload ID: 8172
  Gene Symbol: IDO1
  Gene Name: indoleamine 2,3-dioxygenase 1
  ENST ID: ENST00000519154
  CDS Start-End: 599-1138
gaacaggacaaccaaaactgctctgctcttccgaaaattgcagtcagggaacctgggacccggcaagccagcagaaggagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 142588 - DNA, 612 bp, Homo sapiens
  Payload ID: 8172
  Gene Symbol: IDO1
  Gene Name: indoleamine 2,3-dioxygenase 1
  ENST ID: ENST00000518804
  CDS Start-End: 379-612
ttttctcctattaatctgctttgtcatttgattttcaatgaaccttcagagggcaaaaggaaagttttccctcagctccaacagttttggcccagtgaacaggacaaccaaaactgctctgctcttccgaaaattgcagtcagggaacctgggacccggcaagccagcagaaggaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtgacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 142589 - DNA, 572 bp, Homo sapiens
  Payload ID: 8172
  Gene Symbol: IDO1
  Gene Name: indoleamine 2,3-dioxygenase 1
  ENST ID: ENST00000522840
  CDS Start-End: 431-572
aaccaaaactgctctgctcttccgaaaattgcagtcagggaacctgggacccggcaagccagcagaaggagttaaggaaaatgtttgttctgttaagctttacagaaatggaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtgaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctg

SEQ ID NO: 142590 - DNA, 1709 bp, Homo sapiens
  Payload ID: 8172
  Gene Symbol: IDO1
  Gene Name: indoleamine 2,3-dioxygenase 1
  Uniprot ID: P14902
  ENST ID: ENST00000522495
  CDS Start-End: 257-1468
aggacaaccaaaactgctctgctcttccgaaaattgcagtcagggaacctgggacccggcaagccagcagaaggaggaacgggcaacttggtttcttctttagcttccttgttctcattaagattgaacaatgcctctaaagtgaaccacagacttgcatgcaagctgaaaacctttaccaaatgcagtcttaatttgtactttgagaaaaacattttcaagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaat

SEQ ID NO: 142591 - DNA, 2097 bp, Homo sapiens
  Payload ID: 8172
  Gene Symbol: IDO1
  Gene Name: indoleamine 2,3-dioxygenase 1
  Uniprot ID: P14902
  ENST ID: ENST00000518237
  CDS Start-End: 640-1851
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaa

SEQ ID NO: 142592 - DNA, 1227 bp, Homo sapiens
  Payload ID: 8173
  Gene Symbol: IDO2
  Gene Name: indoleamine 2,3-dioxygenase 2
  Uniprot ID: Q6ZQW0
  ENST ID: ENST00000389060
  CDS Start-End: 1-1224
atggagccccacagaccgaatgtgaagacagcagtgccattgtctttggaaagctatcacatatctgaagagtatggctttcttcttccagattctctgaaagaacttccagatcattataggccttggatggaaattgccaacaaacttcctcaattgattgatgctcaccagcttcaagctcatgtggacaagatgcccctgctgagctgccagttcctgaagggtcaccgggagcagcgcctggcccacctggtcctgagcttcctcaccatgggttatgtctggcaggaaggagaggcgcagcctgcagaggtcctgccaaggaatcttgcccttccatttgtcgaagtctccaggaacttggggctccctcctatcctggtccactcagacttggtgctgacgaactggaccaaaaaagatccagacggattcctggaaattgggaacctggagaccatcatctcatttcctgggggagagagcctgcatggttttatactggtgactgctttggtagagaaagaagcagtgcctgggataaaggctcttgttcaggccacgaatgctatcttgcagcccaaccaggaggccctgctccaagccctgcagcgactgagactgtctattcaggacatcaccaaaaccttaggacagatgcatgattatgtagatccagacatattttatgcaggcatccggatctttctctctggatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggttaggag

SEQ ID NO: 142593 - DNA, 2294 bp, Homo sapiens
  Payload ID: 8173
  Gene Symbol: IDO2
  Gene Name: indoleamine 2,3-dioxygenase 2
  ENST ID: ENST00000502986
  CDS Start-End: 243-1505
agtccagatgatagttaagaaagcagtaagaatacagagagtccacaatgagatgaaaatgcactgccagttgaaacatcctcctacactggagctttataaatattttaaagacaaggattggattagatttgacattagaaatgtaccataatacagaaggcaatggacacctaaagaacagaatgaaaaccttcttaggaaatgaagcttgacacttcacccaccaggccaccacaagaatgttgcattttcattattatgatacttcaaacaaaataatggagccccacagaccgaatgtgaagacagcagtgccattgtctttggaaagctatcacatatctgaagagtatggctttcttcttccagattctctgaaagaacttccagatcattataggccttggatggaaattgccaacaaacttcctcaattgattgatgctcaccagcttcaagctcatgtggacaagatgcccctgctgagctgccagttcctgaagggtcaccgggagcagcgcctggcccacctggtcctgagcttcctcaccatgggttatgtctggcaggaaggagaggcgcagcctgcagaggtcctgccaaggaatcttgcccttccatttgtcgaagtctccaggaacttggggctccctcctatcctggtccactcagacttggtgctgacgaactggaccaaaaaagatccagacggattcctggaaattgggaacctggagaccatcatctcatttcctgggggagagagcctgcatggttttatactggtgactgctttggtagagaaagaagcagtgcctgggataaaggctcttgttcaggccacgaatgctatcttgcagcccaaccaggaggccctgctccaagccctgcagcgactgagactgtctattcaggacatcaccaaaaccttaggacagatgcatgattatgtagatccagacatattttatgcaggcatccggatctttctctctggatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggttaggaggctgccctctccccagcaatgcagagcccccatggagggcaggtgggcctggagaatgagggtcagggttctgcctgggatcatccaggaaggatctcagccctattcatgtttctgctctacagagcactatattctccttgttgagagctgttggcttcacaaaggagagttgatgtggccaagcctttccctccctacctgatcactgcttaacggcatgtataatggatacttcctcatgcagaacccccagaggagtgactgtatgccattctctttgccaagtaatagaaaaccaatctaaatgtcaaaaatcagataaaattgcctggggatacattacttgttgattttcttaaaaaacaaattcacttaacaattcattaagttcatactgagcactgcctccaagattaaaaccaggatttctgtggtcccagaccagccctcttctccctgaatgtgttgagttggtggcaggaggttggaaatgctccagtggagatgggaagatagaggatgctgacaataaggacttggaagtcactagtgtgaaaatgagcagttaatgatatgggaacggatgagactttccacgtggtacctagatttgcaaattctattgtaatgcctttatttttagaagaattattctctcttcttactctgaaaatctgtatttgtaaaatgaatgaatggatcctatataagtaaataagaaaactgggaataagtagtaaatcaatgtgtttagtgtgcaaataaatgtaaatgcttttattg

SEQ ID NO: 142594 - DNA, 2559 bp, Homo sapiens
  Payload ID: 8174
  Gene Symbol: INMT
  Gene Name: indolethylamine N-methyltransferase
  Uniprot ID: O95050
  ENST ID: ENST00000013222
  CDS Start-End: 17-808
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctgagccaggagggccagccagaggtctggtcaggctgtgaggccttggccatctgtatgctagagaggggtgaggaatggatactgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcccgagtagctgggactacaggagctcgccaccacacccagctaatttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagatggggtttcaccgtgttagccaggatggtctcgatctcctgacctggtgatccacccaccttggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggtcagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtgtgtggaagccacgggctcaagcagccaaggcagggcggacagtgtgagagagctagtgtaagctgttgatgagagctgttgctgaataaaaccatattcacctgcc

SEQ ID NO: 142595 - DNA, 803 bp, Homo sapiens
  Payload ID: 8174
  Gene Symbol: INMT
  Gene Name: indolethylamine N-methyltransferase
  Uniprot ID: O95050
  ENST ID: ENST00000409539
  CDS Start-End: 15-803
atttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctga

SEQ ID NO: 142596 - DNA, 2645 bp, Homo sapiens
  Payload ID: 8175
  Gene Symbol: ICOS
  Gene Name: inducible T-cell co-stimulator
  Uniprot ID: Q9Y6W8
  ENST ID: ENST00000316386
  CDS Start-End: 68-667
cgagagcctgaattcactgtcagctttgaacactgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 142597 - DNA, 2528 bp, Homo sapiens
  Payload ID: 8175
  Gene Symbol: ICOS
  Gene Name: inducible T-cell co-stimulator
  Uniprot ID: Q9Y6W8
  ENST ID: ENST00000435193
  CDS Start-End: 36-542
ctgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 142598 - DNA, 1009 bp, Homo sapiens
  Payload ID: 8176
  Gene Symbol: ICOSLG
  Gene Name: inducible T-cell co-stimulator ligand
  Uniprot ID: O75144
  ENST ID: ENST00000344330
  CDS Start-End: 24-953
ggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaaggaaaaaa

SEQ ID NO: 142599 - DNA, 2907 bp, Homo sapiens
  Payload ID: 8176
  Gene Symbol: ICOSLG
  Gene Name: inducible T-cell co-stimulator ligand
  Uniprot ID: O75144
  ENST ID: ENST00000400377
  CDS Start-End: 150-707
agagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 142600 - DNA, 4246 bp, Homo sapiens
  Payload ID: 8176
  Gene Symbol: ICOSLG
  Gene Name: inducible T-cell co-stimulator ligand
  ENST ID: ENST00000400379
  CDS Start-End: 129-1550
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggtgagtttgccgtgggaagcagcaggttctggggggcccaggggaggcttggctgccagctgtctttcagagtttcaaaaaactttcaaaaggcaaaagtcccttgccttgaacaactgttgttcctggagacgcagcgaagccctcgatggtgcgcatggcatttcctgcagcctccccttggcatgggatggcatcctggtgtgcactttgtcacactgcgatgggattttcccaacatgcacagaagcagagagacgagtgctagacccccgcgctccccagtgcccagccccgaccagggtgtccagggcgggtccaggcaccggcgcccagcccccatggggtgtccggagtgggtccaggcaccggcgcccagcccccgtggggtgtccagggcgggtccaggcaccggcgcccagcccctgtggggtgtccggagtgggtccgggcaccgccagcttctctctgtggcagccactcctgcagctctcgtttgcccctcagttccaggagcaacatagatgtggattcctgtccaatttgggaaaaatgtccacacacggtcacccacctggcaggtgcctctggctgcaaggggcgctgggcttcgcaggcaggccagccgggctccccgccatgggccaggatcccctccgagccctgtttgccgcccaggagaaggggttccccggggacagtgggctcagggtgtgcgcagccaccatgctgtggtgtcacctgtggacccaggcgagctgatggccgaccgcagaaacgcacttccaaggccaggtcggcccatccagatgatgcaggaacacagcttgctaaaaacacggccggcctgttcccgtcggagccagtcgaagttccctgaacaggccgctgtttccgaagctttaaaccctgtgtttccaccaagctgagtcctgagaaaaccgacgtctgcctgcagaagggaaaggggtgcttcatgttcctctctctccttcatctcccttccaaggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 142601 - DNA, 7080 bp, Homo sapiens
  Payload ID: 8176
  Gene Symbol: ICOSLG
  Gene Name: inducible T-cell co-stimulator ligand
  Uniprot ID: O75144
  ENST ID: ENST00000407780
  CDS Start-End: 129-1037
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtgcctgtatccagtggctttggtgggtgcagggagtcttgggcacagccagctcagctgtctgtggtatgagcaggaacaggtgccactcctgctcaggggaccctgccctacaccaggctgttccgtccccctggaggacatggggccaggtctggaggcattttgggttgtcacagctgggggctgttcctcggcttcagcgggtggaagcctcagatgctgttcaacatcttctggacacgggaggccccgacagagagaagcgtccacccgcaagtccacagtctgaggtctcccctcagagaccctgccctgcacacccacctccagccaaaggtcctgcctgccccagggctcaggggaaccttgccggtctgtggaacaggagaggggactctcgccagctgcaccaccctgcacgtagtaggtgtgcggtaaacatccaccagggaggctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaaggggcaagactccagaggcctcctctctgcatctccttgtcttcagtggccggaggtgaggcctgagctcaggggaggggcttctgccacgaaccctatggcggggcacagcacacttttcccagggaggacccctgggccccctgcattatccccagcggagtgtggggtcaccttccaagagcgacattgagaagctccagctctaggagtgtgcagactcttaaccaggcaggcccaggccctggggcacacaaaggcggggcctgctctccccagctgcccctgccaatgggggctggactgtcctaccctcctcccttctacctccccactgtcttccctctccactgtcaccactgcctccctcttccactgtcctccatgcactgccctccctccaccttcccccacccccaccactccccatgctgtccccaggctccccccgctctcccccctccccactgtccccctccccatgctgtacccagctcaccccgctctcccctctccccactgtcccccctcccactccccatgctgtccccagctcaccctacatggacttggcgatgtccttccatggctcaccggtctgaatttccatgatgagccgggcctgcagctttgctcccctatccctgcccaggctgcagctgtccatgcagggagcgagctccagcacctgcggagtccttccgtgggggcctctccgtgccacagcagccagggacctcaggtgcctgtgcatgacaccaccgcccatcctcatcctgagccagcctctcaggatcaggacttggtttggcggcgttaaccttagagcctgcaaggggcttcctcctggtgggtctggccgtagcctggggaggccacagctccaggccactccagacctcccttcctctgggccttccatgtggtggcaaccaccgcagctgtaagggagggaaaatggagcgtttgttctcgggctgggctggggtctgggggaagccatgggcgtgaagactggagtattatttgatggagaagcggccactcctggagaccggcggcaaacacagaagcacagcgtggaaggtgctggtgtcagcccacacgggtgatggggtcagactcaggagtcacactcaggagtcaccaggctcaaagggcccaggcaccgcaagtcctgctcagccccagacacaatgcattcctgttgccctcgccctcagccaggccccacgcaggccagggagcactggcaaagcttggcaaccctctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccgaactcaagcaattctgcctcagcctcccaagtagctgggattacaggtgtgcgccaccatgcccaggtaattgtatttttagtagagacagggtttcaccatgttggtcaggctggtttcaaactcctgacctcaaatgatctgcccacctcgacctcccaaagtgctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctccactaaaaatacaaaaattggccaggcacggtggctcacacctgtaatcccagtactttgggaggctgaggtgggcagatcacctgaggtcaggagttcaagaccaacctgaccaacatggagaaaccccatctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaagaaaaaaattagttgggcacggtggcaggcgcctgtaatcccaggtactcaggaggctgaggcaggagaattgcttgaacccgggaggcagaggtcgcagtgagccgagattgcaccactgccctccagcctgggtgacagagcaagactccgtctcaaaaaaaaaaaaaaaaaaaattggatacattgtaatacctcaaatacttgtaagtgaagcaccccagttcccatagagctgccgcactcagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaa

SEQ ID NO: 142602 - DNA, 746 bp, Homo sapiens
  Payload ID: 8177
  Gene Symbol: IVNS1ABP
  Gene Name: influenza virus NS1A binding protein
  ENST ID: ENST00000367497
  CDS Start-End: 52-459
ttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcagcatcttctctacttctgtctgcattcaacatcaacatcatctctcctgtagagcccagttcagatactgcgtttcatgaagccttaccaaattattctacttgaaaatacttatgtgaacttacatagcatttcaatttgttgtacctctccttaaactaaaacttacatatctgtatggcataattagatgtttatcatttgtatacgtgttattaccactattaacatttgttgtattaagacagtgatttttgattctttgtatcttcacatagtctttaccacactgaacattaaatatttgttgaataaaagatatgtaagtgttggcactca

SEQ ID NO: 142603 - DNA, 4199 bp, Homo sapiens
  Payload ID: 8177
  Gene Symbol: IVNS1ABP
  Gene Name: influenza virus NS1A binding protein
  Uniprot ID: Q9Y6Y0
  ENST ID: ENST00000367498
  CDS Start-End: 624-2552
gaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaa

SEQ ID NO: 142604 - DNA, 564 bp, Homo sapiens
  Payload ID: 8177
  Gene Symbol: IVNS1ABP
  Gene Name: influenza virus NS1A binding protein
  ENST ID: ENST00000422754
  CDS Start-End: 1-354
gtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttagttttaaagtaaatgggattcaaccatttttaaaaattattttgctataacatgaaggattccctttcacttttattttataaccatgaccctaaagaatttaaattttgctataggtacccctaagctgagaaacagggggggtgtccaggtgagctgaatgaactgttcagtttggtcttctgcttttctttttttatttctttgcttattatgtgctgttaactttctttaaagtagcatgtaatttgctttagaaa

SEQ ID NO: 142605 - DNA, 1468 bp, Homo sapiens
  Payload ID: 8178
  Gene Symbol: INHA
  Gene Name: inhibin, alpha
  Uniprot ID: P05111
  ENST ID: ENST00000243786
  CDS Start-End: 181-1281
gccacgggcaggggcaactcggactgtggggcgtggaaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatgacttgaca

SEQ ID NO: 142606 - DNA, 6064 bp, Homo sapiens
  Payload ID: 8179
  Gene Symbol: INHBA
  Gene Name: inhibin, beta A
  Uniprot ID: P08476
  ENST ID: ENST00000242208
  CDS Start-End: 248-1528
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgta

SEQ ID NO: 142607 - DNA, 1632 bp, Homo sapiens
  Payload ID: 8179
  Gene Symbol: INHBA
  Gene Name: inhibin, beta A
  Uniprot ID: P08476
  ENST ID: ENST00000442711
  CDS Start-End: 236-1516
ctccctgacagccacaaacctacagcactgactgcattcagagaggaacctgcaaacaaaacttcacagaaaactttttgttcttgttccagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaaca

SEQ ID NO: 142608 - DNA, 3204 bp, Homo sapiens
  Payload ID: 8180
  Gene Symbol: INHBB
  Gene Name: inhibin, beta B
  Uniprot ID: P09529
  ENST ID: ENST00000295228
  CDS Start-End: 47-1270
actcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggatccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacagatggcctcgcctcctcccgggtccgcctatacttcttcatctccaacgaaggcaaccagaacctgtttgtggtccaggccagcctgtggctttacctgaaactcctgccctacgtcctggagaagggcagccggcggaaggtgcgggtcaaagtgtacttccaggagcagggccacggtgacaggtggaacatggtggagaagagggtggacctcaagcgcagcggctggcataccttcccactcacggaggccatccaggccttgtttgagcggggcgagcggcgactcaacctagacgtgcagtgtgacagctgccaggagctggccgtggtgccggtgttcgtggacccaggcgaagagtcgcaccggccctttgtggtggtgcaggctcggctgggcgacagcaggcaccgcattcgcaagcgaggcctggagtgcgatggccggaccaacctctgttgcaggcaacagttcttcattgacttccgcctcatcggctggaacgactggatcatagcacccaccggctactacgggaactactgtgagggcagctgcccagcctacctggcaggggtccccggctctgcctcctccttccacacggctgtggtgaaccagtaccgcatgcggggtctgaaccccggcacggtgaactcctgctgcattcccaccaagctgagcaccatgtccatgctgtacttcgatgatgagtacaacatcgtcaagcgggacgtgcccaacatgattgtggaggagtgcggctgcgcctgacagtgcaaggcaggggcacggtggtggggcacggagggcagtcccgggtgggcttcttccagcccccgcgggaacgggggtacacggtgggctgagtacagtcattctgttgggctgtggagatagtgccagggtgcggcctgagatatttttctacagcttcatagagcaaccagtcaaaaccagagcgagaaccctcaactgacatgaaatactttaaaatgcacacgtagccacgcacagccagacgcatcctgccacccacacagcagcctccaggataccagcaaatggatgcggtgacaaatggcagcttagctacaaatgcctgtcagtcggagagaatggggtgagcagccaccattcccaccagctggcccggccactctgaattgcgccttccgagcacacataaaagcacaaagacagagacgcagagagagagagagagccacggagaggaaaagcagatgcaggggtggggagcgcagctcggcggaggctgcgtgtgccccgtggcttttaccaggcctgctctgcctggctcgatgtctgcttcttccccagcctgggatccttcgtgcttcaaggcctggggagcctgtccttccatgcccttgtcgagggaaagagacccagaaaggacacaacccgtcagagacctgggagcaggggcaatgaccgtttgactgtttgtggcttgggcctctgacatgacttatgtgtgtgtgtgtttttggggtggggagggagggagagaagagggggctaaatttgatgctttaactgatctccaacagttgacaggtcatccttgccagttgtataactgaaaaaggacttttctaccaggtatgaccttttaagtgaaaatctgaattgttctaaatggaaagaaaaaaagttgcaatctgtgcccttcattggggacattcctctaggactggtttggggacgggtgggaatgacccctaggcaaggggatgagaccgcaggaggaaatggcggggaggaggcattcttgaactgctgaggatggggggtgtcccctcagcggaggccaagggaggggagcagcctagttggtcttggagagatggggaaggctttcagctgatttgcagaagttgcccatgtgggccccagccatcagggctggccgtggacgtggcccctgcccactcacctgcccgcctgcccgcccgcccgcatagcacttgcagacctgcctgaacgcacatgacatagcacttgccgatctgcgtgtgtccagaagtggcccttggccgagcgccgaactcgctcgccctctagatgtccaagtgccacgtgaactatgcaatttaaagggttgacccacactagacgaaactggactcgtacgactctttttatattttttatacttgaaatgaaatcctttgcttcttttttaagcgaatgattgcttttaatgtttgcactgatttagttgcatgattagtcagaaactgccatttgaaaaaaagttatttttatagcagcaaaaaaaaaaaaaaaagaatacagttaaatgtattatacataattttggaaccaaagaggccaacagatcagttttaattttattagacggtgaggccatctgagatgaggtggacgttctgagcagtcccttgagtggcctgccaacgtttcagggtatgaatggattttgtttattcggtttgatgtgtcttttccatccttacacacccagaaggtagagtaaaaatgactatgatagaatgcaggtgtgtatccttaaatcctcatctttatgtttatttaataaagctccccttagattctgtttcataataatttaaaaccaaacaattttcccatagacttgctgttaaagtattgtacgtttgtgtacagtttaagaaaataaaagattgagtgccacgggc

SEQ ID NO: 142609 - DNA, 1992 bp, Homo sapiens
  Payload ID: 8181
  Gene Symbol: INHBC
  Gene Name: inhibin, beta C
  Uniprot ID: P55103
  ENST ID: ENST00000309668
  CDS Start-End: 128-1186
caaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaagggctgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgatat

SEQ ID NO: 142610 - DNA, 2429 bp, Homo sapiens
  Payload ID: 8182
  Gene Symbol: INHBE
  Gene Name: inhibin, beta E
  Uniprot ID: P58166
  ENST ID: ENST00000266646
  CDS Start-End: 217-1269
agctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaa

SEQ ID NO: 142611 - DNA, 1056 bp, Homo sapiens
  Payload ID: 8182
  Gene Symbol: INHBE
  Gene Name: inhibin, beta E
  ENST ID: ENST00000547970
  CDS Start-End: 235-1056
tccacatcatgctccaggccaactggactctgggcggccagcacaggcagggtcagggggtgacttctgtgcctcgtggcactgccacctgggcctgagcaagagggctccattctcctacccgcccaaaccctcatccctgtcctagccccagtgctagaaataaagagaccagaattttccttctggcctaagggccccagaggaatacccactggaactcacagctgcctcatggaaactgctgcagcagtggtgaagctagaaagactagaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggat

SEQ ID NO: 142612 - DNA, 6054 bp, Homo sapiens
  Payload ID: 8183
  Gene Symbol: IBTK
  Gene Name: inhibitor of Bruton agammaglobulinemia tyrosine kinase
  Uniprot ID: Q9P2D0
  ENST ID: ENST00000306270
  CDS Start-End: 551-4612
cttcctctacatccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcactaatgtgtgcttgacattttttactatattgacatttattatggaaagagttaataattattttttctgatgtgctacactagtggccagtatatggttaagttgatgctgtatttattctaagacggatttaaaaaggcagttttctaaatatgaacttgtgaatttttgtatgtgtgtttgagtaaattgagaaatgaattttataaatgttctattgatgttgcagtaaagaagccttttgaagtaattga

SEQ ID NO: 142613 - DNA, 5239 bp, Homo sapiens
  Payload ID: 8183
  Gene Symbol: IBTK
  Gene Name: inhibitor of Bruton agammaglobulinemia tyrosine kinase
  ENST ID: ENST00000503400
  CDS Start-End: 468-1184
gcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtaattgaaatgtcattacactatttaggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaa

SEQ ID NO: 142614 - DNA, 3560 bp, Homo sapiens
  Payload ID: 8183
  Gene Symbol: IBTK
  Gene Name: inhibitor of Bruton agammaglobulinemia tyrosine kinase
  ENST ID: ENST00000503631
  CDS Start-End: 80-3538
gcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgca

SEQ ID NO: 142615 - DNA, 721 bp, Homo sapiens
  Payload ID: 8183
  Gene Symbol: IBTK
  Gene Name: inhibitor of Bruton agammaglobulinemia tyrosine kinase
  ENST ID: ENST00000471036
  CDS Start-End: 1-387
ctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagttttgtaggaggagagagaaggtgacatttgagccaactgtaaaagagtgagaagacatttgaagtggaatatattccagaataaggggaatagtaaaaataaagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttg

SEQ ID NO: 142616 - DNA, 4109 bp, Homo sapiens
  Payload ID: 8183
  Gene Symbol: IBTK
  Gene Name: inhibitor of Bruton agammaglobulinemia tyrosine kinase
  ENST ID: ENST00000510291
  CDS Start-End: 80-4096
gcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagatgaaatggacagcattcatgatgtgacatttcaagttggcaatagactcttccctgcacataaatatattttggcagtgcattctgatttttttcagaaattgtttctttcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgtaaaaaaggaaaaaatattagggaagatgatcctgtaagaatgttgcaaactgttgcaaagaaattcgacttcagtaatttgagtagtaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagt

SEQ ID NO: 142617 - DNA, 5195 bp, Homo sapiens
  Payload ID: 8183
  Gene Symbol: IBTK
  Gene Name: inhibitor of Bruton agammaglobulinemia tyrosine kinase
  ENST ID: ENST00000610980
  CDS Start-End: 551-4009
cttcctctacatccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccaccggcgcagtttcatctagcgactggtcacccttgcaattatggatatttaaaagggtcagacagtgtggagggggagttcccctcctcactcccccttggtgcttgactccaggaataatttataaactgtggaatttttttaaatgaagaacttgtatttgatatgaactttatagagctatttataatttttttgatttaagtgccaaaaaattgtataaagatatatagttttatactattgtcaggaggatttaaattatcctaaaaaggtaatttattctctgtaacttcctcaatagcacctttgtgtcctggctttttcattttttaaaattagttttcacgattctgaagtaagtggtataaaaacagttaggatgagttcacccatgcctgactgcacatcaaagtgtcgatccctgaagcatgctttggatgtcctttctgtggtaacaaaggggagcgaaaaccagattaaggcctttctctccagtcattgttacaatgctgcaactatcaaggatgtttttggcaggaatgccctccaccttgtttcctcctgtggaaagaaaggagtgttagattggcttattcagaaaggagtggatctgttggtgaaagacaaagagtctggatggacagcattgcacagaagcattttttatggacatattgattgtgtttggtctctattgaagcatggtgttagtctgtatattcaagataaagaaggcttgtcagctttggatcttgtaatgaaggatagaccaactcatgtagtattcaagaatactgatcctacagatgtttatacttggggcgataatacaaattttaccctgggtcatggaagccagaatagcaaacatcatccagagttggtggatctgttctccaggagtgggatttatatcaagcaggtggtgctttgtaaatttcactccgtgtttctgtctcagaaagggcaggtttatacctgtggtcatggtcctggagggcgattaggacatggagatgaacagacatgcttggtccctcggcttgtggaaggactgaatggtcataattgttcccaagtggcagctgctaaggatcatactgttgtattaactgaagatggatgtgtttatacatttggtctaaacatttttcatcaattaggaattattccaccgccttccagttgtaatgtacccagacagatacaggcaaaatatctgaaaggaaggacaatcattggcgttgcagcaggcaggtttcatacagtcctatggactagagaagctgtttacactatgggactaaatggtggacaactgggttgtttgctagatcccaatggagaaaagtgtgtaactgctcctcgtcaggtctctgcccttcaccataaagacattgctctgtctttggttgctgcaagtgatggagctacagtctgtgttaccacaaggggagatatttacttacttgcagactatcagtgcaagaagatggcttctaaacagttgaacttgaaaaaagttcttgtgtctgggggtcatatggaatacaaggttgatcctgaacatttgaaagaaaatgggggtcaaaaaatttgcattcttgcaatggatggagctggaagggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaaggttagatggagtcagatttgaaaatgaaaaaattaatgttattgccaagaacactggtaataaactgaagctaagtcagaaaaaatgttcatttctgtgtgacgtgaccatgaaatcagtggatggaaaggaatttccttgtcataaatgtgttctttgtgctagacttgaatattttcatagtatgctgagtagctcatggattgaggcttccagttgtgcagctctggaaatgccaatacattctgatatattaaaagttattttggactacctctatactgatgaagctgtggtgataaaagaatctcaaaatgtagattttatttgtagtgttcttgtggtggctgatcaacttctcataacccggttgaaagagatttgtgaagtagcattaactgaaaaacttaccctgaagaatgctgctatgctactggaatttgcagcaatgtatagtgcaaaacagttgaaactgtcttgtttacagtttataggattgaatatggcagctttacttgaagcaaggtctcttgatgttttaagcgatggtgttttgaaggatctttctgagttttaccggaaaatgattccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacgttcagatagttctggaggttataacctttcagatattattcagagtccatcatctacaggattattaaagtctggtaagaccaattctgtggaatctcttccagaactgttgacatcagactctgaaggaagctatgcaggagtgggtagtcctagagatttacagtcccctgatttcacaacaggatttcattcagataagattgaggcgaaagtcaaaccgtatgttaatggtacatctcctgtgtattctagggaagatttaaaaccatgggaaaagtcaccaatacttaaaatatctgctccacagcctattcccagtaacagaattgatactaccagctctgccagttgggttgctggttctttcagtcctgtcagccctcctgttgtggatctcagaactatcatggaaatagaagaaagtagacaaaaatgtggagctacaccaaagtcacatttaggcaaaacagtttctcatggagttaaactttctcagaagcaacgaaaaatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggcaccaaaaattgtcagatgctctacccatggtaccccaggaccagaaggcaaccatatttcagatttaccacttctagacagtcccaatccctggctatcttcttcagtgactgctccatccatggtagccccagtcacttttgcatctattgtagaagaagaactacaacaagaagcagctcttattagaagtcgagaaaaaccgttggctctgattcagattgaggagcatgccatacaagatttattggttttctatgaggcatttggcaaccctgaagagtttgtcattgttgaaaggacaccgcagggaccactggcagtacctatgtggaataagcatggatgctagttcactgtggagttgagatgcattttacataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtaaagtattaaaaataacttttttgtttgataacttgagaatttagaagattttgccaagtatgtgttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttc

SEQ ID NO: 142618 - DNA, 721 bp, Homo sapiens; identical to SEQ ID NO: 142615
  Payload ID: 8183
  Gene Symbol: IBTK
  Gene Name: inhibitor of Bruton agammaglobulinemia tyrosine kinase
  ENST ID: ENST00000634571
  CDS Start-End: 1-387

SEQ ID NO: 142619 - DNA, 3560 bp, Homo sapiens; identical to SEQ ID NO: 142614
  Payload ID: 8183
  Gene Symbol: IBTK
  Gene Name: inhibitor of Bruton agammaglobulinemia tyrosine kinase
  ENST ID: ENST00000634695
  CDS Start-End: 80-3538

SEQ ID NO: 142620 - DNA, 5239 bp, Homo sapiens; identical to SEQ ID NO: 142613
  Payload ID: 8183
  Gene Symbol: IBTK
  Gene Name: inhibitor of Bruton agammaglobulinemia tyrosine kinase
  ENST ID: ENST00000634585
  CDS Start-End: 468-1184

SEQ ID NO: 142621 - DNA, 6054 bp, Homo sapiens; identical to SEQ ID NO: 142612
  Payload ID: 8183
  Gene Symbol: IBTK
  Gene Name: inhibitor of Bruton agammaglobulinemia tyrosine kinase
  ENST ID: ENST00000635454
  CDS Start-End: 551-4612

SEQ ID NO: 142622 - DNA, 4109 bp, Homo sapiens; identical to SEQ ID NO: 142616
  Payload ID: 8183
  Gene Symbol: IBTK
  Gene Name: inhibitor of Bruton agammaglobulinemia tyrosine kinase
  ENST ID: ENST00000635384
  CDS Start-End: 80-4096

SEQ ID NO: 142623 - DNA, 5195 bp, Homo sapiens; identical to SEQ ID NO: 142617
  Payload ID: 8183
  Gene Symbol: IBTK
  Gene Name: inhibitor of Bruton agammaglobulinemia tyrosine kinase
  ENST ID: ENST00000635314
  CDS Start-End: 551-4009

SEQ ID NO: 142624 - DNA, 1383 bp, Homo sapiens
  Payload ID: 8184
  Gene Symbol: INCA1
  Gene Name: inhibitor of CDK, cyclin A1 interacting protein 1
  Uniprot ID: Q0VD86
  ENST ID: ENST00000355025
  CDS Start-End: 443-1108
gctcaggccccgccctcagacgagcaccgcccgccggctcctcccgcggctcgaatcgccgtctctctcctccccgccccgccgagttctagaattcgccgcgcagctgcttcagcccctcagccccagccggaccctcgggtcctcatccaccctcgcaggcgcaggccgtggctaccccgaagtcaactgtggaggatccttcctggcttccttcagctccatcctgcccttggatctaggtcacccgcttggacccaactatctgaggcccgaatgccccgcagctcccgctgctccctcgcgttctgctgacccccctccgagtcaggacatcccctttagaccccactttaggccctttcagcccaactccaactagccccatctgccgcttccgcacgcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggagcaccccaagtcctgttttcctccaggccccgctcctggccttgtattctctctgctctgttattaaaaagcaagcaagtgga

SEQ ID NO: 142625 - DNA, 1260 bp, Homo sapiens
  Payload ID: 8184
  Gene Symbol: INCA1
  Gene Name: inhibitor of CDK, cyclin A1 interacting protein 1
  Uniprot ID: Q0VD86
  ENST ID: ENST00000574617
  CDS Start-End: 357-1067
tccttcagctccatcctgcccttggatctaggtcacccgcttggacccaactatctgaggcccgaatgccccgcagctcccgctgctccctcgcgttctgctgacccccctccgagtcaggacatcccctttagaccccactttaggccctttcagcccaactccaactagccccatctgccgcttccgcacgagacagagtttcactcttgttgcacagactggagtgcaatggcgcgatctcaactcaccgcaacctctgcctccctggttcaagcaattctcctgcctcagcctcctgagtagctgggattacagcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgagagccactggttgctcccagcttggtctgtatcctcctgagcagctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggag

SEQ ID NO: 142626 - DNA, 973 bp, Homo sapiens
  Payload ID: 8184
  Gene Symbol: INCA1
  Gene Name: inhibitor of CDK, cyclin A1 interacting protein 1
  Uniprot ID: Q0VD86
  ENST ID: ENST00000576820
  CDS Start-End: 70-780
tccttcagctccatcctgcccttggatctagcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgagagccactggttgctcccagcttggtctgtatcctcctgagcagctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggag

SEQ ID NO: 142627 - DNA, 1221 bp, Homo sapiens
  Payload ID: 8184
  Gene Symbol: INCA1
  Gene Name: inhibitor of CDK, cyclin A1 interacting protein 1
  Uniprot ID: Q0VD86
  ENST ID: ENST00000575780
  CDS Start-End: 281-946
gctcaggccccgccctcagacgagcaccgcccgccggctcctcccgcggctcgaatcgccgtctctctcctccccgccccgccgagttctagaattcgccgcgcagctgcttcagcccctcagccccagccggaccctcgggtcctcatccaccctcgcaggcgcaggccgtggctaccccgaagtcaactgtggaggatccttcctggcttccttcagctccatcctgcccttggatctagcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggagcaccccaagtcctgttttcctccaggccccgctcctggccttgtattctctctgctctgttattaaaaagcaagcaagtgga

SEQ ID NO: 142628 - DNA, 1233 bp, Homo sapiens
  Payload ID: 8185
  Gene Symbol: ID1
  Gene Name: inhibitor of DNA binding 1, dominant negative helix-loop-helix protein
  Uniprot ID: P41134
  ENST ID: ENST00000376105
  CDS Start-End: 106-555
actctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaaa

SEQ ID NO: 142629 - DNA, 994 bp, Homo sapiens
  Payload ID: 8185
  Gene Symbol: ID1
  Gene Name: inhibitor of DNA binding 1, dominant negative helix-loop-helix protein
  Uniprot ID: P41134
  ENST ID: ENST00000376112
  CDS Start-End: 106-573
actctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaaa

SEQ ID NO: 142630 - DNA, 2041 bp, Homo sapiens
  Payload ID: 8186
  Gene Symbol: ID2
  Gene Name: inhibitor of DNA binding 2, dominant negative helix-loop-helix protein
  Uniprot ID: Q02363
  ENST ID: ENST00000234091
  CDS Start-End: 861-1265
gcgcgctgagtgacggcgcggttgccatggcagccgcctgagcggcgccgcgaggacaaggctgcagggcggcgtgaatgggcggcgtcacgcgcctggcgccagagagtctgctccggggctccggctccggccccgccgcggcctggcccgcgcgccgccgccgccgccaccgccgccgccaattcatcacctgtcagggatcactcgcggggtcacgggcggaatggacacagctgtgagaacaaaacccgggaaagaaaggcgaacgctccccattgcgccagatgtgcagggaggaccttgagacgcgccccccgcccccgcaggctcctcccgccccccggcgcatcacgcgggggtggcaaaggcggcctggccagcgcggagctcccggcccggagctgcttctgattaccgcgaggggcccggacgcgagagccgccgcggggcctgccctagaggcggagtgatgaactgtggcttcccccctgcggtgctgaactcgcccgtgtagctgtgattttagagctgccgacagctctaagctgggctcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaa

SEQ ID NO: 142631 - DNA, 1362 bp, Homo sapiens
  Payload ID: 8186
  Gene Symbol: ID2
  Gene Name: inhibitor of DNA binding 2, dominant negative helix-loop-helix protein
  Uniprot ID: Q02363
  ENST ID: ENST00000396290
  CDS Start-End: 184-588
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtc

SEQ ID NO: 142632 - DNA, 623 bp, Homo sapiens
  Payload ID: 8186
  Gene Symbol: ID2
  Gene Name: inhibitor of DNA binding 2, dominant negative helix-loop-helix protein
  Uniprot ID: Q02363
  ENST ID: ENST00000331129
  CDS Start-End: 111-515
attctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttg

SEQ ID NO: 142633 - DNA, 1251 bp, Homo sapiens
  Payload ID: 8187
  Gene Symbol: ID3
  Gene Name: inhibitor of DNA binding 3, dominant negative helix-loop-helix protein
  Uniprot ID: Q02535
  ENST ID: ENST00000374561
  CDS Start-End: 369-728
gatctggggtgctgccaggaaaaagcaaattctggaagttaatggttttgagtgatttttaaatccttgctggcggagaggcccgcctctccccggtatcagcgcttcctcattctttgaatccgcggctccgcggtcttcggcgtcagaccagccggaggaagcctgtttgcaatttaagcgggctgtgaacgcccagggccggcgggggcagggccgaggcgggccattttgaataaagaggcgtgccttccaggcaggctctataagtgaccgccgcggcgagcgtgcgcgcgttgcaggtcactgtagcgggacttcttttggttttctttctctttggggcacctctggactcactccccagcatgaaggcgctgagcccggtgcgcggctgctacgaggcggtgtgctgcctgtcggaacgcagtctggccatcgcccggggccgagggaagggcccggcagctgaggagccgctgagcttgctggacgacatgaaccactgctactcccgcctgcgggaactggtacccggagtcccgagaggcactcagcttagccaggtggaaatcctacagcgcgtcatcgactacattctcgacctgcaggtagtcctggccgagccagcccctggaccccctgatggcccccaccttcccatccagacagccgagctcactccggaacttgtcatctccaacgacaaaaggagcttttgccactgactcggccgtgtcctgacacctccagaacgcaggtgctggcgcccgttctgcctgggaccccgggaacctctcctgccggaagccggacggcagggatgggccccaacttcgccctgcccacttgacttcaccaaatcccttcctggagactaaacctggtgctcaggagcgaaggactgtgaacttgtggcctgaagagccagagctagctctggccaccagctgggcgacgtcaccctgctcccaccccacccccaagttctaaggtctcttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaactttttataaaagttaacattttgcataataaacgatttttaaacacttgtgtatatgatga

SEQ ID NO: 142634 - DNA, 1251 bp, Homo sapiens; identical to SEQ ID NO: 142633
  Payload ID: 8187
  Gene Symbol: ID3
  Gene Name: Inhibitor of DNA binding 3, dominant negative helix-loop-helix protein
  ENST ID: ENST00000634790
  CDS Start-End: 369-728

SEQ ID NO: 142635 - DNA, 2344 bp, Homo sapiens
  Payload ID: 8188
  Gene Symbol: ID4
  Gene Name: inhibitor of DNA binding 4, dominant negative helix-loop-helix protein
  Uniprot ID: P47928
  ENST ID: ENST00000378700
  CDS Start-End: 370-855
aggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgta

SEQ ID NO: 142636 - DNA, 1029 bp, Homo sapiens
  Payload ID: 8188
  Gene Symbol: ID4
  Gene Name: inhibitor of DNA binding 4, dominant negative helix-loop-helix protein
  ENST ID: ENST00000618493
  CDS Start-End: 315-794
gcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgccctcgggccgcaaggccgtcgggctgcggcggcggggagctggcgctgcgctgcctggccgagcacggccacagcctgggtggctcccaggcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttca

SEQ ID NO: 142637 - DNA, 5119 bp, Homo sapiens
  Payload ID: 8189
  Gene Symbol: ING1
  Gene Name: inhibitor of growth family, member 1
  Uniprot ID: Q9UK53
  ENST ID: ENST00000333219
  CDS Start-End: 873-1712
gcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacagccgtgcttatgtgcgtatgtattgtctgactgcttttgcaaaacggcagagttcaatagttgcacctgaaaccatttgacttgacaagccaaaactattttctggccctctgcagaaagggtttgctgacctctgatttagactagcatctaacattgatttgcccacatattgaaagggtcagtggagttttcatttattattttttatttttttgagattgagttccaggctggagtgcaatagcgcaatcttggctcaccgcaacctccgcctcccaggttcaagcgattgtcctgcctcagcctccccagtagctaggattacaggcatgcaccaccacgcctggctaattttgtattttcagtagagacgcggtttctccatgttggtcatggctggtctcgcactcccgacctcaggtgatccacctgcctcagccttccaaagtgctgggattacaggtgtgagccaccgtgcccggctggagttttcatttttttttttttttttttttctgagatggagtctcactctgtctccaggctagagtgcagtggcccagtcttggctcactgcaacctctgcctctcgggttcaagcgattctcttgcctcagcctcccgagtagctgggactacaggtgcgtgccaccatgcccagctaatttttgtatttttagtagagatgggttttcaccatgttggccagtatggtctcgagctcttgaccatgatccgcccacctcggcctcccacagtgctgggattacaggcgtgagccaccgtgcgctgagtgatacgtggttccctttaacttcgcacatggtaaaatcagtttctttccatgatctgtttcacagtctctgtgaagctacctaccacaaagaagtagtgagtgatgactttctagaatctaagtatatggcatgtatttattataagtaaaacattaagtttgctgattgtttacttgtgataaacaattattgtgaactttatttgtgctggacataagtgtctgttttacagtgaaattccattatagagggttacttggtagagaaatgcaaattgtagttggtcatatactaaaatttgaactttttacatatcaatacttacaaataggtgtttattttcccacaaaactccagaacatttaagagtctcgggtgtttaaatttgatgagatttacccaaacaaatagtgaacaaaaggtttatgaaaataagttatgaaactaaaatacttaataaacatccagtgacaataaaaatagcttgagtctttgcttatataaaatttcatgctaatttttcacttctatattaattggaggtaataatgcaaattaagttatagaaatgaagattcaatgaaatgcagttgctcatcctggatttcttcatattcagttttggtgtagacaactggtgaagagagatggctcagaggccaagccttgcaatctaggagcccagccctgtcctttaagggcttgatcttgaataaattgcttaacagttggtctatagttctacacttttaaagtatgtttcacagagggtggttccaataaataaatgcactggcatattcaaatgttggataatttttctctagctttcttcaagtttctcataaggacaggtgggtagccacttattctttaaaaaaaaatagatacaatacagagtcgtgttggactggcagtcttaaatcactcttgttatttccagtggacattaaaaaaaaatcacagataagtacttaaaacactcaagatttgggatttagatcatgattagatacaatagaaagatcctggaatcccgacatgaggacaaaaatggtactgaattctttttgaaaaatagattactgaaaagcgatctaatatagaacagttgcttttacttagatgttcaatgcatatttgttgtataataaccaagttattacagttcagataaagggtccaaagtgttttcgttatgatataatactttctattgtaaactggactaaagaaacgttgtatgttcaaggaagtgttgagcagccatggtgttcctgggacaggctccccaggtgctgagagaggtgctgcaggagtcacagacctgcaggcacgcacttgccagtgactgggacgttggctggtggttctcttttggtgtgattagagctatgtgagttgtctcaatacttgagactgtcggtggttgccaatgctgaataaagcatttatcaaagtaaaa

SEQ ID NO: 142638 - DNA, 1189 bp, Homo sapiens
  Payload ID: 8189
  Gene Symbol: ING1
  Gene Name: inhibitor of growth family, member 1
  Uniprot ID: Q9UK53
  ENST ID: ENST00000338450
  CDS Start-End: 239-946
cctccgagaacggtgtccatgacacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatggagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaaca

SEQ ID NO: 142639 - DNA, 2870 bp, Homo sapiens
  Payload ID: 8189
  Gene Symbol: ING1
  Gene Name: inhibitor of growth family, member 1
  ENST ID: ENST00000375774
  CDS Start-End: 463-1731
agcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctatccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgccccggcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctctgctgacccgagggtggggccgcgcgtggccgtggaaacagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaac

SEQ ID NO: 142640 - DNA, 1074 bp, Homo sapiens
  Payload ID: 8189
  Gene Symbol: ING1
  Gene Name: inhibitor of growth family, member 1
  Uniprot ID: Q9UK53
  ENST ID: ENST00000375775
  CDS Start-End: 199-831
cgccgtccacaccccagcggccctgacgctgtcccctccgcgaccctcgcctctggaaaaagtgacaggcaaggccacgcccccgcgagggccggcctggagcccgcagcccccagggcctgggacgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaaca

SEQ ID NO: 142641 - DNA, 340 bp, Homo sapiens
  Payload ID: 8189
  Gene Symbol: ING1
  Gene Name: inhibitor of growth family, member 1
  ENST ID: ENST00000464141
  CDS Start-End: 8-340
ggctgtgatgtccttcgtggaatgtccttatcattcccctgcggaacgattggtcgctgaggcggatgaaggcgggcctagcgcaataactgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaag

SEQ ID NO: 142642 - DNA, 1189 bp, Homo sapiens
  Payload ID: 8190
  Gene Symbol: ING2
  Gene Name: inhibitor of growth family, member 2
  Uniprot ID: Q9H160
  ENST ID: ENST00000302327
  CDS Start-End: 203-1045
cgcccctgggctggtgctgcgggggcggggagtgagggctgctctggggggagtggagatcggggagcgcggccgtgccctctcgagcggctgcggggtccccgcggcgccgggctgctgagctgagggcccgcggcggccgcggccggtgcatgtgcggctgctggatgcggaggcggcggcgacggcgcggatcggcaggatgttagggcagcagcagcagcaactgtactcgtcggccgcgctcctgaccggggagcggagccggctgctcacctgctacgtgcaggactaccttgagtgcgtggagtcgctgccccacgacatgcagaggaacgtgtctgtgctgcgagagctggacaacaaatatcaagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttg

SEQ ID NO: 142643 - DNA, 599 bp, Homo sapiens
  Payload ID: 8190
  Gene Symbol: ING2
  Gene Name: inhibitor of growth family, member 2
  ENST ID: ENST00000412117
  CDS Start-End: 186-599
gtgggaggggcgcggcgcgcgttcccgcgggcctggaaaatggctggtcgcgagaggggcggtggcgagctggctgctggggagggagtcggggctgtgcgggggcgttggttcggccccagcggagtccgaatcggggtttgcagcatgttttgcggtgatgtttccaacctctttcccagtcaatggatcaggacggcgatcagcagctcggaccgtcgcggatcctggctccgcaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacct

SEQ ID NO: 142644 - DNA, 3777 bp, Homo sapiens
  Payload ID: 8191
  Gene Symbol: ING3
  Gene Name: inhibitor of growth family, member 3
  Uniprot ID: Q9NXR8
  ENST ID: ENST00000315870
  CDS Start-End: 149-1405
tttttttttttttctttttttttttttgccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaagtcagtgcttctaaaaagaatttaagataatggtttttaaaatgcctttataataagctttgtttctttgtgaaactaattcagcaggctgaaggaaatggttcatgtgataatgtgggctggtatcctctagagtacctgggtacataaacagaaactcctgtaggtaaaaagtaatttgtgccattagtctttctatgtttctgcatccagatagagtgcagttcatgagggagggggcgggggactgaaggggaaagggcgttaaagtgatacatttttataccaaatgtgtttatttttttgtgcaagtaatccttaaaattgcaattgtattaggtgttaaaataaagtttttaaaaaattacttgtatttatactttacatacttaataatgaaaatttctgaattccaattaactttcaactttcataatctaaaaagaatcagagacccaggacacagaatactgtgtaatctgtgatgtctttaatgatgtttagagtttgtgatataagaatacaggaaagacatttttaatgtaaatttgaaatgccaatgtatttttttaagaacatcatctggcttttccttcagtctaaaagacatgaaagaagtgtaagtatagcagttaaaacgaaaataatggttatgggtgttttgactggaggcaatgtagccaaatagagtaaagagacccccctggtcgggagctccaaattgagctatttttgattctaccacttactgatatgacagttaattcaaattttgtatcactctgggccttactacaccagggtgatgctgactgcagaatagatcttattctaaggtgctatttaaattataaatttgcatagtggaggttttatttaaagtataatattgagtctggtcgatagaaaaatccttaacttttaagatacttaatatatcatatatattttatattgaaacttactgggtccatcagatttctgctttaattaaaccacttatgagcttcttagaacttattcagataacagtgtaaaatctatgcagtgctacccaaagggtgtgaggtagataggggatttcaaagatctcttccacctttgagatcccatgattctgagctgccacagtctgattatacaactctaccagctccctaaacaagttaggttcatttgtgagtactcatcatttcataatatcatgattatcacgatttcatgatactcaatattttgagattttataaccctttaagaagtgataaataatgtagtattcaattcgtttatcaaagtatattgcctggaaatgctcacatgtatcatttacatcctctatatattatgactattccaaactcattcattttatagaaatggtcaaaggaaaaagccttatgtacagccttatttgaagagaaagttctttgtctgagtcaggaacatcctgttatccagctgctacatcccctttcagtgtgaattccactccttaccaaatcacttagaaaacactttgacaagttttaaactcaaacactgaatattttatgaagcatgtgtaaagaaagaaaccaaaatttggtgcaggtatttagtaatgggtagaacctgttaatatctgagtcatatataatggggccaaacatggaactacctcatcaaccccccaaaaatgtggccaactattaatattctttgtgacatttacaccaaggggcatagtaagtatttttggtattataaaatacacattcaaaatctctgttgtacaaaactcatgtaacagttgggacaaaatatccaaatgtgggttcacagttcacaggtggtgaaaattgaggccttactgctatggagtgtatatcaaaatgttcatggtgacacatttgaagcaataaatggcttaattaaatgccaaaa

SEQ ID NO: 142645 - DNA, 1222 bp, Homo sapiens
  Payload ID: 8191
  Gene Symbol: ING3
  Gene Name: inhibitor of growth family, member 3
  Uniprot ID: Q9NXR8
  ENST ID: ENST00000339121
  CDS Start-End: 135-413
tttttttttttttgccggagtcgagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttgcagcacttctaaaagattgaaaacaccaagaagatagatagaatattcactatttctcatattgatgcaattgtggtgctctttttcatttgaaacatcttctcctaaaatatacactttaagaaatagtcatttctgtttttgcattaaagtaaattaaagcagaaaacacatgctcacttttggctaacttcagtgtatagatttcatacttatgttgtctttcctgggtacagatttattactgaacaagtacgtgtaagtaaaatgtcattggtgagcaggacacaagataaaaggtgaacaccacatatggtgtgaattgtaaatgcttataccacaaacttgaaaatgtgtcatgtagagccatggaaaatgtctagttgtttttatgtagtacacacattttaatggtgctaacaacctgggctcttttgttcatagagttattctgaaaaaaatttcataaaagacactgcctaaagataggtagaataggctgtagcttgatttactgtggaataaaaaccaaaaaaaaaaaggtcttaattgtttcagtctttaattatgtctataaacttagaaaaaggcatttacatttgaatctagactaatttgtttagtaacattcttcctcatattcaatgactgtatgtatcagtccttatttagagactgcctgctttttaattcatatagctctttggttctattctttgttttgtttattattttgttgttttattgcttgttagacctttactaaagatattttgtgtatttagaaaaaatataacataaatatatgctttttaaatatg

SEQ ID NO: 142646 - DNA, 1447 bp, Homo sapiens
  Payload ID: 8191
  Gene Symbol: ING3
  Gene Name: inhibitor of growth family, member 3
  ENST ID: ENST00000431467
  CDS Start-End: 66-1277
gtatttcgccgttggccccgcccctctgacggactctccctttgacagtgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtagatcgacacttgagaaagctggatcaggaactggctaagtttaaaatggagctggaagctgataatgctggaattacagaaatattagagaggcgatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtatttt

SEQ ID NO: 142647 - DNA, 1723 bp, Homo sapiens
  Payload ID: 8191
  Gene Symbol: ING3
  Gene Name: inhibitor of growth family, member 3
  ENST ID: ENST00000445699
  CDS Start-End: 103-402
tgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggtaagtaaaagtaatgtgcatactgtgccataagtacttgaataacagattatatcttaaattgtattggcttaaatgtagtaggaagaagcaactaaaactgaagtattgctctcttgatcacatctaatttgacatttcagtgtccattttatggtttctttgtggaaaagtcagagtggttagttaatgtggtgagaactgtacattttagcaagtctatacggcggtaaggtggtttctgatgttagatattttttaaacaagaattaatgtttaactttattttactaatccttgtcttcttaaggtagtgtgtttacttgccttatacatcattttgagattgtttctgtggtaaaatacacctaagaagactgctttgacaagagttcttggtagtctgattaaaatgaagaagaatcatttgaatcagtgtttatgtgagtgatgttaaaagatcgtatgtaacagctgtgtcagttgtttaagcaatacaagatgacaaactttaaacaagattctttttttgcagcagcacttctaaaagattgaaaacaccaagaagatagatagaatattcactatttctcatattgatgcaattgtggtgctctttttcatttgaaacatcttctcctaaaatatacactttaagaaatagtcatttctgtttttgcattaaagtaaattaaagcagaaaacacatgctcacttttggctaacttcagtgtatagatttcatacttatgttgtctttcctgggtacagatttattactgaacaagtacgtgtaagtaaaatgtcattggtgagcaggacacaagataaaaggtgaacaccacatatggtgtgaattgtaaatgcttataccacaaacttgaaaatgtgtcatgtagagccatggaaaatgtctagttgtttttatgtagtacacacattttaatggtgctaacaacctgggctcttttgttcatagagttattctgaaaaaaatttcataaaagacactgcctaaagataggtagaataggctgtagcttgatttactgtggaataaaaaccaaaaaaaaaaaggtcttaattgtttcagtctttaattatgtctataaacttagaaaaaggcatttacatttgaatctagactaatttgtttagtaacattcttcctcatattcaatgactgtatgtatcagtccttatttagagactgcctgctttttaattcatatagctctttggttctattctttgttttgtttattattttgttgttttattgcttgttagacctttactaaagatattttgtgtatttagaaaaaatataacataaatatatgctttttaaata

SEQ ID NO: 142648 - DNA, 1718 bp, Homo sapiens
  Payload ID: 8191
  Gene Symbol: ING3
  Gene Name: inhibitor of growth family, member 3
  Uniprot ID: Q9NXR8
  ENST ID: ENST00000427726
  CDS Start-End: 113-394
gagcgggtgctgctagcggaggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcagaatgcaatggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggatctttggaattagacactccttcacagccagtgaacaatcaccatgctcattcacatactccagtggaaaaaaggaaatataatccaacttctcaccatacgacaacagatcatattcctgaaaagaaatttaaatctgaagctcttctatccacccttacgtcagatgcctctaaggaaaatacactaggttgtcgaaataataattccacagcctcttctaacaatgcctacaatgtgaattcctcccaacctctgggatcctataacattggctcgttatcttcaggaactggtgcaggggcaattaccatggcagctgctcaagcagttcaggctacagctcagatgaaggagggacgaagaacatcaagtttaaaagccagttatgaagcatttaagaataatgactttcagttgggaaaagaattttcaatggccagggaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttatggtgagatggtgggatgtgataaccaagattgccctatagaatggttccattatggctgcgttggattgacagaggcaccaaaaggcaaatggtactgtccacagtgcactgctgcaatgaagagaagaggcagcagacacaaataaaggtggtccttttgtttgatgaagaaataaacttcagctgaagattttatataggactttaaaaagaagagaagagaaagaagaaacaatgcatttccaggcaaccacttaaaggatttacatagacaatcctataagatcttgaacttgaattttatgggttgtattttaataatgtaagtaaattatttatgcactcctggtgtgctatgaatattattccagttagccttggattatttcagtggccaacatatgcagacatttgtactcctcaaccattttctcaaagtaatgggcattctatgatttagacttcaaggaattccaatgatgaagattttaaggaaagtattttatattcaacaggtatattctgctgcatgtactgtactccagagctgttatgtaacactgtatataaatggttgcaaaaaaaaaaaaaa

SEQ ID NO: 142649 - DNA, 1709 bp, Homo sapiens
  Payload ID: 8192
  Gene Symbol: ING4
  Gene Name: inhibitor of growth family, member 4
  Uniprot ID: Q9UNL4
  ENST ID: ENST00000341550
  CDS Start-End: 48-794
acagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcaatgtgagaggatggcatgccagaattaggacacgacatgaaaccagagtggtgcctctgtccgagaacttgtaagttctcaacttgggaaagacagaggtgctggagggtaggcctcagaccagggggtctccaaaactttgtaaatcatgcatcttttctccataaaacatctttcacttaatttccaataaatgatgtatttgtgctatacatacgtactgctatactata

SEQ ID NO: 142650 - DNA, 1393 bp, Homo sapiens
  Payload ID: 8192
  Gene Symbol: ING4
  Gene Name: inhibitor of growth family, member 4
  Uniprot ID: Q9UNL4
  ENST ID: ENST00000396807
  CDS Start-End: 40-789
ttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 142651 - DNA, 678 bp, Homo sapiens
  Payload ID: 8192
  Gene Symbol: ING4
  Gene Name: inhibitor of growth family, member 4
  Uniprot ID: Q9UNL4
  ENST ID: ENST00000444704
  CDS Start-End: 1-678
atggctgcggggatgtatttggaacattatctggacaacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatag

SEQ ID NO: 142652 - DNA, 741 bp, Homo sapiens
  Payload ID: 8192
  Gene Symbol: ING4
  Gene Name: inhibitor of growth family, member 4
  Uniprot ID: Q9UNL4
  ENST ID: ENST00000412586
  CDS Start-End: 1-741
atggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatag

SEQ ID NO: 142653 - DNA, 602 bp, Homo sapiens
  Payload ID: 8192
  Gene Symbol: ING4
  Gene Name: inhibitor of growth family, member 4
  Uniprot ID: Q9UNL4
  ENST ID: ENST00000423703
  CDS Start-End: 1-540
atggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcactgttccattgagtggttccattttgcctgtgtggggctgacaaccaagcctcgggggaaatggttttgcccacgctgctcccaagaacggaagaagaaatag

SEQ ID NO: 142654 - DNA, 1348 bp, Homo sapiens
  Payload ID: 8192
  Gene Symbol: ING4
  Gene Name: inhibitor of growth family, member 4
  Uniprot ID: Q9UNL4
  ENST ID: ENST00000446105
  CDS Start-End: 42-779
acttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaag

SEQ ID NO: 142655 - DNA, 1150 bp, Homo sapiens
  Payload ID: 8192
  Gene Symbol: ING4
  Gene Name: inhibitor of growth family, member 4
  ENST ID: ENST00000488381
  CDS Start-End: 29-172
atcggaagttgctttgttttgcttcgagatggctgcggggatgtatttggaacattatctggacagtattgaaaaccttccctttgaattacagagaaactttcagctcatgagggacctagaccaaagaacagaggaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacacagttccctgagaactgcctgccgaatgacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggag

SEQ ID NO: 142656 - DNA, 776 bp, Homo sapiens
  Payload ID: 8192
  Gene Symbol: ING4
  Gene Name: inhibitor of growth family, member 4
  ENST ID: ENST00000469749
  CDS Start-End: 14-169
gttttgcttcgagatggctgcggggatgtatttggaacattatctggacagtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggagggg

SEQ ID NO: 142657 - DNA, 659 bp, Homo sapiens
  Payload ID: 8192
  Gene Symbol: ING4
  Gene Name: inhibitor of growth family, member 4
  ENST ID: ENST00000482489
  CDS Start-End: 1-111
aaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacgtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttc

SEQ ID NO: 142658 - DNA, 911 bp, Homo sapiens
  Payload ID: 8192
  Gene Symbol: ING4
  Gene Name: inhibitor of growth family, member 4
  ENST ID: ENST00000479301
  CDS Start-End: 29-172
atcggaagttgctttgttttgcttcgagatggctgcggggatgtatttggaacattatctggacagtattgaaaaccttccctttgaattacagagaaactttcagctcatgagggacctagaccaaagaacagaggaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacacagttccctgagaactgcctgccgaatgacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcacc

SEQ ID NO: 142659 - DNA, 397 bp, Homo sapiens
  Payload ID: 8192
  Gene Symbol: ING4
  Gene Name: inhibitor of growth family, member 4
  ENST ID: ENST00000493873
  CDS Start-End: 334-397
atttggaacattatctggacagtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatccca

SEQ ID NO: 142660 - DNA, 529 bp, Homo sapiens
  Payload ID: 8192
  Gene Symbol: ING4
  Gene Name: inhibitor of growth family, member 4
  ENST ID: ENST00000467678
  CDS Start-End: 377-529
ttggaacattatctggacagttcaagtgattctcctgcctcagcctcctgaatagctgggattacaggtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccat

SEQ ID NO: 142661 - DNA, 1280 bp, Homo sapiens
  Payload ID: 8192
  Gene Symbol: ING4
  Gene Name: inhibitor of growth family, member 4
  ENST ID: ENST00000619641
  CDS Start-End: 42-197
acttccggggcggatcggaagttgctttgttttgcttcgagatggctgcggggatgtatttggaacattatctggacagtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattc

SEQ ID NO: 142662 - DNA, 5196 bp, Homo sapiens
  Payload ID: 8193
  Gene Symbol: ING5
  Gene Name: inhibitor of growth family, member 5
  Uniprot ID: Q8WYH8
  ENST ID: ENST00000313552
  CDS Start-End: 27-749
gaccccgagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccggtacagcccgggctccgcgtgccccgcccgctggagcacctgccaccgaggcgcgcgtggggccactgccgtggcggcggctgccctcctcacactcggctccgcgccgcctccggccaccgtgcgctcccgcgtggggcgcctcggatgggcccgggagggctgggggctcttccctggaggaagcggcctccgcttcgctggcgccgcctttttagcttggacttcagtcctccctcggggactcacctccggagtaaacggctcttcattagcttggagtggccgcaggtcccgtgaccagcacccgcgagaccctgtgcgacagctgggctgatgctccgtttctctgggaattggtgattttttactgtgaagatgaaattaccctaatagcatgaagatcgtgggtctgtgtgtccgtgaagtgagtcccgtctgccaggagctgacgaaccacgaatgcttctgcctgtgctgtgcattcccaggcccgcagctcccggtcgaggggactccgatgtgaatttgttgtgaatttgttgtgccacaatagcagttctggaatgaagctaggaaactcgagtgtgctttttgtttaatgagcgttcaccaagctgagccggagccatcctttcggtggtagttggggaaggctatgcagatttgctctgttgtgacgcgttggtgacggtgcccagcctgcggttccccacagcatcgcaggcgctcggaaatcctctcccgtgcctttagaggaaggagaggattgctgaggaatgcagggacgcctgtttctgtcctcacaccacagaaagaaacctgagggaaaactgagacgtgaggttcctgatttaagaagcctgggtttcttcatggtggggggccatttggaatgacagcctcacttccttctgatggctacatctgtatcttttcctcctgtgtttaatgtttcactagggagaggaaataaagcagaaggaacgtgtgaagctctgtgtctcagacggggccctcccgtcgagaagctggtagtcagtgagtgagaacaagagaacaagaacaccctgaacagtcctggttgggatggtgtccacattcatgttctgcggttcttgaacacacggatgcctctgggccacctgtccttttccgagggtgtgggtgggagtggatcctccgggcgcaggtgccaggcaggtgcaggcgggcggtcggccactgctgctgctcgtccctgccagtgtctgggcctgaaggggctccctccaagcggtgccttcctgcggcttagaagggaaagcgccagagagggcaggctacagtgcttcacacccttcgccacggctgtgaaactggagatgggtgggttttgtatgttaatttttttttttgagacggagtcttgctctgtcacccaggctggagagcagtggcgtgatctcggctcactgcaagctccgcctcccgggttcacgccattctcctgcctcagcccccccgagtagctgggactacaggcgcccgccaccacgcctggctaattttttatatttttagtagagacagggtttcaccatgttaaccaggatggtctcgatctcctgacctcacgatttgcccgcctcggcttcccagagtgctgggattacaggcgtgagccaccgcgcctggccacccagctaagtttgtatttttgttggagacggggtttcaccatattggccagactggtctcaaactcctggggtcaaatgatccgcctgcgtcggcttcccagagtgctgggattacaggtgtcagccactgcgctcagctgggagatgaattttcatttaatgacttaactttttgttagcacaggttttgtgtgtgtgtgtgtgtgtgtgttttgttttttgttttgtgtttttgaaacggagttttgctctgtcacccaggctggaatgcaatggcaccatcttggctcactgcaacctctgcttcctgggttcaagtgattctcttgccttagcctcccgagcagctgggattataggcgtccaccaccacgcccagctaatttttgtatttttagtagaaatggggtttcaccatgtgtggccaggctggtctcgaactcctgacctgaagtgatccacccgcctcgacctcccaaagtgctgggatgacaggcatgagccaccgcacccggccaacacagatgtttattgatcgtggaggatacattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttctacccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggacatggatgccaagcggaggcctgcgtggcctcctgagcagcagctgaccgcccgtctcatgctggacgggacccctgggcgggtggacatgagaccactgttggccagggacgccgtgcggaggcctacgtggctgcctgagcagcagctgaccgcccgtctcactgttggccagggctttgtggcgtgggtgttttccagtctgcctggagcagcgagaagcagctgtgcagactggtggcggtgggagggtttgctgggactgatggggacaccggccagcttgtctggtgtccagcagccctgccggacttggcctcctgtcctgtcgttgggagccctggctggggctgctttgagcaatgacgctggcccagagcagcttcccacatgaccccagagccgagggtctgccctgtcctaggttaggtcttcatggtttagagtaaaaccgtgagggatgttaattatgggcattgaagacttaaggttttcttaaatttttagtgagcagtgattggccttcaatacttgtgctgagaggaattttaagccaggggaagtgtaagaaaatgttcccattcaggagagattgtgttggagtttctttcttcctctgtatgtattttgtggtgtccacctttaaccacgtttcatccaaaacgatgatgcagctttaacatgaatgttacatttttattttcaaggaattattatctatgttccctttgtaaaggaaagataatgttgtaaatctttttattagataatgtaaagatgtatatcagtatttttggatcatgttatagattatggatatattgtttaataaataaagtattttttggaacaaa

SEQ ID NO: 142663 - DNA, 946 bp, Homo sapiens
  Payload ID: 8193
  Gene Symbol: ING5
  Gene Name: inhibitor of growth family, member 5
  Uniprot ID: Q8WYH8
  ENST ID: ENST00000406941
  CDS Start-End: 21-701
gagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatgatttcatttaaataaaaacctgtagtctgggcaacatcgggagaccccaactctacaaaaaatacaaaaattagctgggcgtggtggtgcgtgcctgtggtcccaactacctgggaggcggaggcgggaggatggcttgagcctggaagtccgaggcttcagtgagctgagatcgcgccactgcactccagcctgggcgagagagcaagaccctgtctcaaataaataaataaaaagataaaaacc

SEQ ID NO: 142664 - DNA, 662 bp, Homo sapiens
  Payload ID: 8193
  Gene Symbol: ING5
  Gene Name: inhibitor of growth family, member 5
  ENST ID: ENST00000445620
  CDS Start-End: 6-434
cgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaagcaagtctgttaattttttttctttattttattactgttaactatggagttttgaagagttttgtcacggtaaatcattaaagtatgatcactaggaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacg

SEQ ID NO: 142665 - DNA, 3952 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000342222
  CDS Start-End: 155-649
cgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattggtaaatcccagtcccggaattcaggccgtgtccttcagggagagtgtggtgcccctcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaa

SEQ ID NO: 142666 - DNA, 4036 bp, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENST ID: ENST00000416505
  CDS Start-End: 269-2362
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 142667 - DNA, 447 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000518983
  CDS Start-End: 119-349
aatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaa

SEQ ID NO: 142668 - DNA, 2196 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000521661
  CDS Start-End: 53-1741
gagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacgg

SEQ ID NO: 142669 - DNA, 2501 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000517890
  CDS Start-End: 173-319
ggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactg

SEQ ID NO: 142670 - DNA, 954 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000522147
  CDS Start-End: 19-348
agttagcacgacatcagtatgagctggtcaccttccctgacaacgcagacatgtggggcctgggaaatgaaagagcgccttgggacagggggatttggaaatgtcatccgatggcacaatcaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctgg

SEQ ID NO: 142671 - DNA, 3777 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000520655
  CDS Start-End: 639-2327
ccgacaggtgagtccccctcgtgggtgcggcccgggtgccacctgcaggccccgccgccccgctgcctgcaaggcccggaagacccctctgtgccgctgggaagtcgcagcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaagtaggttctgcccctgccacctcgggcagaaggcgggcaggcccgggcgcccctggtggagtcagctggggatcccctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaa

SEQ ID NO: 142672 - DNA, 1966 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000523105
  CDS Start-End: 171-317
aagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcag

SEQ ID NO: 142673 - DNA, 527 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000519733
  CDS Start-End: 171-326
aagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcagcctctgcgcttagataccttcatgaaaacagaatcatccatcgggatctaaagccagaaaacatcgtcctgcagcaaggagaacagagggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggccctt

SEQ ID NO: 142674 - DNA, 523 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000517812
  CDS Start-End: 181-327
gcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaaagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatcta

SEQ ID NO: 142675 - DNA, 628 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000520320
  CDS Start-End: 179-325
agagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattggtaaatcccagtcccggaattcaggccgtgtccttcagggagagtgtggtgcccctcctctgcgcttagataccttcatgaaaacagaatcatccatcgggatctaaagccagaaaacatcgtcctgcagcaaggagaacagaggttaatacacaaa

SEQ ID NO: 142676 - DNA, 577 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000517388
  CDS Start-End: 99-245
atagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagagggatatgccaaggagctggatcagggcagtctttgcacatcattcgtggggaccctgcagtacctggccccagagctactggagcagcagaagtacac

SEQ ID NO: 142677 - DNA, 2378 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000523517
  CDS Start-End: 19-1146
agttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttc

SEQ ID NO: 142678 - DNA, 1166 bp, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENST ID: ENST00000519735
  CDS Start-End: 171-941
aagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtgcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtaatcccagctactcggaaggctgaggtgggagaattgcttaaacccaggaggcagaggtcgcatcactgcaatccagcctgggcgacagagtgagactctgtctcaaaacaaaaaaagtttaaaaaaaaaaaaaacaa

SEQ ID NO: 142679 - DNA, 2784 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000518679
  CDS Start-End: 170-301
agtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaat

SEQ ID NO: 142680 - DNA, 3086 bp, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENST ID: ENST00000520810
  CDS Start-End: 187-2457
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctac

SEQ ID NO: 142681 - DNA, 2403 bp, Homo sapiens
  Payload ID: 8194
  Gene Symbol: IKBKB
  Gene Name: inhibitor of kappa light polypeptide gene enhancer in B-cells, kinase beta
  Uniprot ID: O14920
  ENST ID: ENST00000520835
  CDS Start-End: 54-2318
aagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctg

SEQ ID NO: 142682 - DNA, 4069 bp, Homo sapiens
  Payload ID: 8194
  Gene Symbol: IKBKB
  Gene Name: inhibitor of kappa light polypeptide gene enhancer in B-cells, kinase beta
  ENST ID: ENST00000629753
  CDS Start-End: 187-1875
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 142683 - DNA, 5905 bp, Homo sapiens
  Payload ID: 8195
  Gene Symbol: IKBKAP
  Gene Name: inhibitor of kappa light polypeptide gene enhancer in B-cells, kinase complex-associated protein
  Uniprot ID: O95163
  ENST ID: ENST00000374647
  CDS Start-End: 309-4307
agtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttcccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 142684 - DNA, 2840 bp, Homo sapiens
  Payload ID: 8195
  Gene Symbol: IKBKAP
  Gene Name: inhibitor of kappa light polypeptide gene enhancer in B-cells, kinase complex-associated protein
  ENST ID: ENST00000495759
  CDS Start-End: 1-1040
gacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccgacatggggagagggagtcttgctgtgttgcccaagctggtcttgaactcctggcctcaagtgatcctcctgccttggcctcccaaagtgctgagattacaggtgttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttcccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 142685 - DNA, 3823 bp, Homo sapiens
  Payload ID: 8195
  Gene Symbol: IKBKAP
  Gene Name: inhibitor of kappa light polypeptide gene enhancer in B-cells, kinase complex-associated protein
  ENST ID: ENST00000537196
  CDS Start-End: 398-3349
gggtgcggactgtgggagctgactctgggtagccggctgcgcgtggctggggaggcgaggccggacgcacctctgtttgggggtcctcagaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttg

SEQ ID NO: 142686 - DNA, 2487 bp, Homo sapiens
  Payload ID: 8196
  Gene Symbol: IKBKE
  Gene Name: inhibitor of kappa light polypeptide gene enhancer in B-cells, kinase epsilon
  Uniprot ID: Q14164
  ENST ID: ENST00000584998
  CDS Start-End: 463-2358
caccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtgggaaatccggagagctggttgctgtgaaggtcttcaacactaccagctacctgcggccccgcgaggtgcaggtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggc

SEQ ID NO: 142687 - DNA, 3221 bp, Homo sapiens
  Payload ID: 8196
  Gene Symbol: IKBKE
  Gene Name: inhibitor of kappa light polypeptide gene enhancer in B-cells, kinase epsilon
  Uniprot ID: Q14164
  ENST ID: ENST00000581977
  CDS Start-End: 327-2477
caccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagctcctggaagagctatctcaccagctccttcaggaccgagcaaagggggctcaggcctcgccgcctcccatagctccttaccccagccctacacgaaaggacctgcttctccacatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgcctttctccctgggaagcagcacagctgagactgggcaccaggccacctctgttgggacccacaggaaagagtgtggcagcaactgcctggctgacctttctatcttctctaggctcaggtactgctcctccatgcccatggctgggccgtggggagaagaagctctcatacgccttcccactccctctggtttataggacttcactccctagccaacaggagaggaggcctcctggggtttccccagggcagtaggtcaaacgacctcatcacagtcttccttcctcttcaagcgtttcatgttgaacacagctctctccgctcccttgtgatttctgagggtcaccactgccagcctcaggcaacatagagagcctcctgttctttctatgcttggtctgactgagcctaaagttgagaaaatgggtggccaaggccagtgccagtgtcttggggcccctttggctctccctcactctctgaggctccagctggtcctgggacatgcagccaggactgtgagtctgggcaggtccaaggcctgcaccttcaagaagtggaataaatgtggcctttgcttctgtt

SEQ ID NO: 142688 - DNA, 2493 bp, Homo sapiens
  Payload ID: 8196
  Gene Symbol: IKBKE
  Gene Name: inhibitor of kappa light polypeptide gene enhancer in B-cells, kinase epsilon
  ENST ID: ENST00000578328
  CDS Start-End: 327-2300
caccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctgcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtaccggatcaccacggagaagccggctggggccattgcaggtgcccagaggcgggagaacgggcccctggagtggagctacaccctccccatcacctgccagctgtcactggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccctgctctggacgtccccaagttcgtccccaaagtggacctgcaggcggattacaacactgccaagggcgtgttgggcgccggctaccaggccctgcggctggcacgggccctgctggatgggcaggagctaatgtttcgggggctgcactgggtcatggaggtgctccaggccacatgcagacggactctggaagtggcaaggacatccctcctctacctcagcagcagcctgggaactgagaggttcagcagcgtggctggaacgcctgagatccaggaactgaaggcggctgcagaactgaggtccaggctgcggactctagcggaggtcctctccagatgctcccaaaatatcacggagacccaggagagcctgagcagcctgaaccgggagctggtgaagagccgggatcaggtacatgaggacagaagcatccagcagattcagtgctgtttggacaagatgaacttcatctacaaacagttcaagaagtctaggatgaggccagggcttggctacaacgaggagcagattcacaagctggataaggtgaatttcagtcatttagccaaaagactcctgcaggtgttccaggaggagtgcgtgcagaagtatcaagcgtccttagtcacacacggcaagaggatgagggtggtgcacgagaccaggaaccacctgcgcctggttggctgttctgtggctgcctgtaacacagaagcccagggggtccaggagagtctcagcaagcatgcaagagctctgcgaggggatgaagctgctggcatctgacctcctggacaacaaccgcatcatcgaacggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggc

SEQ ID NO: 142689 - DNA, 580 bp, Homo sapiens
  Payload ID: 8196
  Gene Symbol: IKBKE
  Gene Name: inhibitor of kappa light polypeptide gene enhancer in B-cells, kinase epsilon
  ENST ID: ENST00000605726
  CDS Start-End: 143-580
agtgctggggagaggtggtagagacaagaggtttgtctctgcagaatgacctgcctcaggaggggcttcaagggaacgtggggagccaggacaggcagcaggtggaacaggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtggtggccggcatgaaccacctgcgggagaacggcattgtgcatcgcgacatcaagccggggaacatcatgcgcctcgtaggg

SEQ ID NO: 142690 - DNA, 678 bp, Homo sapiens
  Payload ID: 8196
  Gene Symbol: IKBKE
  Gene Name: inhibitor of kappa light polypeptide gene enhancer in B-cells, kinase epsilon
  ENST ID: ENST00000579827
  CDS Start-End: 180-641
aagctctgggggtgtcacccagtcccacaagcctgcatcccctgcagtggagatgggctcagctcctggacgtgccacagacagaaagcataacatacactcgccaggaagagcctttgcctgactcagggcagctcagagtgtggggcagaaggtgaccagccagctcagggcaggagatgcagagcacagccaattacctgtggcacacagatgacctgctggggcagggggccactgccagtgtgtacaaggcccgcaacaagaaatccggagagctggttgctgtgaaggtcttcaacactaccagctacctgcggccccgcgaggtgcaggtgagggagtttgaggtcctgcggaagctgaaccaccagaacattgtcaagctctttgcggtggaggagacgggcggaagccggcagaaggtactggtgatggagtactgctccagtgggagcctgctgagtgtgctggagagccctgagaatgcctttgggctgcctgaggatgagttcctggtggtgctgcgctgtgtgggtgagcccctccctgtccctgcctccaccctcagaccagcggcaggcctgggacagatgctgacaggactcaggtgtctgactcctgctaatcattccatttaaaattccaacttaaaaattaaacctaaaaaagattgta

SEQ ID NO: 142691 - DNA, 841 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000422680
  CDS Start-End: 324-841
ccacgctccaggccgtttgttcctgctgctccctttgggattaactagagattgaaccggctcaccttgtttcagctcaggccctgcaaccgaccgaccgtctgctgggctccaagtcacctgagaggcgaggtgaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcg

SEQ ID NO: 142692 - DNA, 960 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000440286
  CDS Start-End: 209-960
acagactccagaaaggtactggtggcaggggactggtctgctgagtcacagcaaccccacgctccaggccgtttgttcctgctgctccctttgggattaactagagattgaaccggctcaccttgtttcagctcaggccctgcaaccgaccgaccgtctgctgggctccaagtcacctgagaggcgaggtgagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtggg

SEQ ID NO: 142693 - DNA, 693 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000445622
  CDS Start-End: 280-693
gagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggac

SEQ ID NO: 142694 - DNA, 892 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000413620
  CDS Start-End: 306-892
ggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagag

SEQ ID NO: 142695 - DNA, 2299 bp, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENST ID: ENST00000594239
  CDS Start-End: 455-1714
gttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 142696 - DNA, 1654 bp, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENST ID: ENST00000611176
  CDS Start-End: 120-1082
aagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcggaggaagctggcccagttgcaggtggcctatcaccagctcttccaagaatacgacaaccacatcaagagcagcgtggtgggcagtgagcggaagcgagcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 142697 - DNA, 1463 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000619941
  CDS Start-End: 124-1362
agggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtgggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggt

SEQ ID NO: 142698 - DNA, 488 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000615186
  CDS Start-End: 144-488
agcgttcacagtccgccgctcccacccttctcacgtctgacggactctgctgacagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtg

SEQ ID NO: 142699 - DNA, 2103 bp, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENST ID: ENST00000611071
  CDS Start-End: 259-1518
agcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 142700 - DNA, 1972 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000612051
  CDS Start-End: 2-148
catggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 142701 - DNA, 1460 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000615874
  CDS Start-End: 124-1359
agggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtgggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggt

SEQ ID NO: 142702 - DNA, 2069 bp, Homo sapiens
  Payload ID: 8197
  Gene Symbol: IKBKG
  Gene Name: inhibitor of kappa light polypeptide gene enhancer in B-cells, kinase gamma
  Uniprot ID: Q9Y6K9
  ENST ID: ENST00000618670
  CDS Start-End: 21-1484
cctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 142703 - DNA, 1949 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000617207
  CDS Start-End: 121-1377
gaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaa

SEQ ID NO: 142704 - DNA, 552 bp, Homo sapiens
  Payload ID: 8197
  Gene Symbol: IKBKG
  Gene Name: inhibitor of kappa light polypeptide gene enhancer in B-cells, kinase gamma
  ENST ID: ENST00000492469
  CDS Start-End: 1-546
gagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacaga

SEQ ID NO: 142705 - DNA, 2877 bp, Homo sapiens
  Payload ID: 8198
  Gene Symbol: INMT-FAM188B
  Gene Name: INMT-FAM188B readthrough (NMD candidate)
  ENST ID: ENST00000458257
  CDS Start-End: 15-440
atttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagggacatggagttaattaataacacgactcttgtcaattcacgacatcctgccatcactggtccttgagaggccatcttttattaactaatgaatcaatagaaataatataaaagatgctgaagaaacaaatacactcatgacacccagagcacgacggatacttatcattacctgcgttgttctcatctgccatgtccttgaccttcccattcccagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacagacactatctgagacggtcctcaccgtcaagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacacggacaggatgcccttgaagctctacttgcctggtggtaattccaggatgacccaggagaggctggaaagagcgttcaaacggcagggcagccagcccgcacctgtcaggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcct

SEQ ID NO: 142706 - DNA, 975 bp, Homo sapiens
  Payload ID: 8198
  Gene Symbol: INMT-FAM188B
  Gene Name: INMT-FAM188B readthrough (NMD candidate)
  ENST ID: ENST00000451002
  CDS Start-End: 1-367
gaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacaga

SEQ ID NO: 142707 - DNA, 3698 bp, Homo sapiens
  Payload ID: 8199
  Gene Symbol: INCENP
  Gene Name: inner centromere protein antigens 135/155kDa
  Uniprot ID: Q9NQS7
  ENST ID: ENST00000278849
  CDS Start-End: 178-2922
agttttgaaaatcatagttttcgcccgcgctgcgccgcctggttgctcctcccgtgcggtgagtcccgaaggcccggagccaagtgggtctgggcaagcggggccttacctagggataccaccggacttggatcggagcagccttcaggggacgtggcgcagtcgaacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgaccccgacctcagccccacgcagcgtcatgaagtcctttattaagcgcaacactcccctgcgcatggaccccaaggagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggaggcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacgtgcagtctccagcttgtacctcatatcagatgactccgcaagggcacagggcccctcccaagatcaacccagataactacgggatggatctgaatagcgacgactccaccgatgatgaggcccatccccggaagcccatccccacctgggcccgaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaagg

SEQ ID NO: 142708 - DNA, 3964 bp, Homo sapiens
  Payload ID: 8199
  Gene Symbol: INCENP
  Gene Name: inner centromere protein antigens 135/155kDa
  Uniprot ID: Q9NQS7
  ENST ID: ENST00000394818
  CDS Start-End: 203-2959
cttgccgaggattggctgagccttcagttttgaaaatcatagttttcgcccgcgctgcgccgcctggttgctcctcccgtgcggtgagtcccgaaggcccggagccaagtgggtctgggcaagcggggccttacctagggataccaccggacttggatcggagcagccttcaggggacgtggcgcagtcgaacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgaccccgacctcagccccacgcagcgtcatgaagtcctttattaagcgcaacactcccctgcgcatggaccccaagtgcagcttcgtcgagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggaggcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacgtgcagtctccagcttgtacctcatatcagatgactccgcaagggcacagggcccctcccaagatcaacccagataactacgggatggatctgaatagcgacgactccaccgatgatgaggcccatccccggaagcccatccccacctgggcccgaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagtt

SEQ ID NO: 142709 - DNA, 570 bp, Homo sapiens
  Payload ID: 8199
  Gene Symbol: INCENP
  Gene Name: inner centromere protein antigens 135/155kDa
  ENST ID: ENST00000533896
  CDS Start-End: 70-570
agttttgaaaatcatagttttcgcccgcgctgcgccgcctggttgctcctcccgtgcgacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcct

SEQ ID NO: 142710 - DNA, 2613 bp, Homo sapiens
  Payload ID: 8200
  Gene Symbol: IMMT
  Gene Name: inner membrane protein, mitochondrial
  ENST ID: ENST00000254636
  CDS Start-End: 298-2277
agtgctgaaggtcgacgggcgagaactacagttcccgtcaggacgagcggagcggcggcttgttgcatccttaataaggagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactga

SEQ ID NO: 142711 - DNA, 2515 bp, Homo sapiens
  Payload ID: 8200
  Gene Symbol: IMMT
  Gene Name: inner membrane protein, mitochondrial
  ENST ID: ENST00000409051
  CDS Start-End: 52-2187
gcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatg

SEQ ID NO: 142712 - DNA, 1408 bp, Homo sapiens
  Payload ID: 8200
  Gene Symbol: IMMT
  Gene Name: inner membrane protein, mitochondrial
  ENST ID: ENST00000409258
  CDS Start-End: 52-495
gcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacaggaaagtataaataccatgagtaacatatatttatagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtatgtttcctaagtcttatagtattttatattttaaaatataatctcttaaaggattttaaggatttaggaaaacagcaaattcctaccatctccccgtcttttctcctgcaaagtgtattcgttgttactgttttaaaaaatttgccttggctgggtgtggtggttcacacctgtaatcccagcactttggcaggccgaggtgggcagataacttgagcccaggagtttgagaccagcctgggcaacatggtgaaactctgtttctacaaaaaatacaaaaataagt

SEQ ID NO: 142713 - DNA, 3001 bp, Homo sapiens
  Payload ID: 8200
  Gene Symbol: IMMT
  Gene Name: inner membrane protein, mitochondrial
  Uniprot ID: Q16891
  ENST ID: ENST00000410111
  CDS Start-End: 389-2665
aattctctttaagagtcacagctgtccattttccacgtgcggctgaagaatggatttcagagcgctctccctccggcagtgttcacctagtaaccccttccggataaggacctgcagcccgggcgcgacccggaaagggaatccgcccttttcgcctccttcgcgccaatcgcctggagttggcgtttccgcagccgggacacagcccaccctctaagagccgcggagtcggggacggtagaaggggccgcgcgtgcgcagtggcgtccgctgtgcttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactga

SEQ ID NO: 142714 - DNA, 2670 bp, Homo sapiens
  Payload ID: 8200
  Gene Symbol: IMMT
  Gene Name: inner membrane protein, mitochondrial
  Uniprot ID: Q16891
  ENST ID: ENST00000449247
  CDS Start-End: 91-2334
gcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactga

SEQ ID NO: 142715 - DNA, 2627 bp, Homo sapiens
  Payload ID: 8200
  Gene Symbol: IMMT
  Gene Name: inner membrane protein, mitochondrial
  Uniprot ID: Q16891
  ENST ID: ENST00000442664
  CDS Start-End: 22-2295
agcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 142716 - DNA, 2172 bp, Homo sapiens
  Payload ID: 8200
  Gene Symbol: IMMT
  Gene Name: inner membrane protein, mitochondrial
  ENST ID: ENST00000419070
  CDS Start-End: 1-1840
gattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 142717 - DNA, 1520 bp, Homo sapiens
  Payload ID: 8200
  Gene Symbol: IMMT
  Gene Name: inner membrane protein, mitochondrial
  ENST ID: ENST00000620815
  CDS Start-End: 83-1201
gcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagc

SEQ ID NO: 142718 - DNA, 795 bp, Homo sapiens
  Payload ID: 8201
  Gene Symbol: IMMP1L
  Gene Name: inner mitochondrial membrane peptidase subunit 1
  Uniprot ID: Q96LU5
  ENST ID: ENST00000278200
  CDS Start-End: 197-697
gaaaagtgcgccctacgaaaggacggtcgacttcggcggggcccaggtgagaaaggcccacctgtgtcctggttgagggtctccagggttctttggggcccgaggaatttcagacctgaacaatcaggtggacaacttcttgtgactttgggtattctgaaattactgccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattc

SEQ ID NO: 142719 - DNA, 475 bp, Homo sapiens
  Payload ID: 8201
  Gene Symbol: IMMP1L
  Gene Name: inner mitochondrial membrane peptidase subunit 1
  ENST ID: ENST00000529749
  CDS Start-End: 155-475
aggacggtcgacttcggcggggcccaggtgagaaaggcccacctgtgtcctggttgagggtctccagggttctttggggcccgagcatcttgactctactgtgcctggatgtagctgtgtgttttgccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttat

SEQ ID NO: 142720 - DNA, 314 bp, Homo sapiens
  Payload ID: 8201
  Gene Symbol: IMMP1L
  Gene Name: inner mitochondrial membrane peptidase subunit 1
  ENST ID: ENST00000533642
  CDS Start-End: 134-307
aaccaatcggaaggcgtattgctgaaaagtgcgccctacgaaaggacggtcgacttcggcggggcccaggtgagaaaggcccacctgtgtcctggttgagggtctccagggttctttggggcccgaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcat

SEQ ID NO: 142721 - DNA, 437 bp, Homo sapiens
  Payload ID: 8201
  Gene Symbol: IMMP1L
  Gene Name: inner mitochondrial membrane peptidase subunit 1
  ENST ID: ENST00000531331
  CDS Start-End: 1-91
ttgtaaaagagtaattggtttggaaggagacaaaatcctcaccactagtccatcagatttctttaaaagccatagttatcatttcagataagagatactcaacctgcaacttatagaggtggatcagcaaagatgcctgctttaattttaaaagatctgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 142722 - DNA, 612 bp, Homo sapiens
  Payload ID: 8201
  Gene Symbol: IMMP1L
  Gene Name: inner mitochondrial membrane peptidase subunit 1
  ENST ID: ENST00000534812
  CDS Start-End: 340-513
cttcggcggggcccaggtgagaaaggcccacctgtgtcctggttgagggtctccagggttctttggggcccgaggtgaagcgacttccagtcatttggaaaggatgggatgaaaaggaaccttggtgataattttgatgtctgcaagatttagtaccagtgtaatgggattatcggtaacaccttcactgcagaaaaagccacctggcgctataactggcagcaactgagaactaatcctttcccatctcttggatgtcattcatgaagctcaaagctatttctgccctgctaactgtgattaattttataaacaacaacaacaaaaaatcaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 142723 - DNA, 552 bp, Homo sapiens
  Payload ID: 8201
  Gene Symbol: IMMP1L
  Gene Name: inner mitochondrial membrane peptidase subunit 1
  ENST ID: ENST00000530023
  CDS Start-End: 265-552
gcgtattgctgaaaagtgcgccctacgaaaggacggtcgacttcggcggggcccaggtgagaaaggcccacctgtgtcctggttgagggtctccagggttctttggggcccgaggaatttcagacctgaacaatcaggtggacaacttcttgtgactttgggtattctgaaattactcatcttgactctactgtgcctggatgtagctgtgtgttttgtgtgtatcctgttcatggccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccact

SEQ ID NO: 142724 - DNA, 469 bp, Homo sapiens
  Payload ID: 8201
  Gene Symbol: IMMP1L
  Gene Name: inner mitochondrial membrane peptidase subunit 1
  ENST ID: ENST00000526776
  CDS Start-End: 86-370
gagaaaggcccacctgtgtcctggttgagggtctccagggttctttggggcccgaggccaatggtggcagagtctacatagaactatgcttcgtggtgttctggggaaaacctttcgacttgttggctatactattcaatatggctgtatagctcattgtgcttttgaatacgttggtggtgttgtcatggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 142725 - DNA, 685 bp, Homo sapiens
  Payload ID: 8201
  Gene Symbol: IMMP1L
  Gene Name: inner mitochondrial membrane peptidase subunit 1
  Uniprot ID: Q96LU5
  ENST ID: ENST00000532287
  CDS Start-End: 86-586
gagaaaggcccacctgtgtcctggttgagggtctccagggttctttggggcccgaggccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 142726 - DNA, 1205 bp, Homo sapiens
  Payload ID: 8202
  Gene Symbol: IMMP2L
  Gene Name: inner mitochondrial membrane peptidase subunit 2
  Uniprot ID: Q96T52
  ENST ID: ENST00000331762
  CDS Start-End: 130-657
cggcggagggcggggtctgcgcggggacttcccccgggctgagctgcgcagcggggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttg

SEQ ID NO: 142727 - DNA, 1522 bp, Homo sapiens
  Payload ID: 8202
  Gene Symbol: IMMP2L
  Gene Name: inner mitochondrial membrane peptidase subunit 2
  Uniprot ID: Q96T52
  ENST ID: ENST00000405709
  CDS Start-End: 444-971
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttgcta

SEQ ID NO: 142728 - DNA, 1164 bp, Homo sapiens
  Payload ID: 8202
  Gene Symbol: IMMP2L
  Gene Name: inner mitochondrial membrane peptidase subunit 2
  Uniprot ID: Q96T52
  ENST ID: ENST00000447215
  CDS Start-End: 77-409
gggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagagatgggagaaaactgaaaaggatatgaaacagaaacttccgaatcagtgacaagaatgaaagctttagatgataagattgtaacaatcaggtgtttaagcagcctttagtaatgtcgtatttattgtacttgctgataaatcaagaacaattgttgacattcagcaagtaaatactgtgtggcatgatgtgtctcattgtgatcgctttctttaaacaagttgtagccaggcctatacaatgtggtagccaaaatgctttgactactacattgaggaagttttctgaccctgttttctaaaaaaacttgatcctaaagtatttgtattaatgatagtacacatattaactaatctcactgaaatgaacctcagtcagttttagagcagattctaggctagcagttctcacagcatggccagaggatcccaggggatccccactgggggcctatgagattaaaactactttcctaataatactaaagtgttacttgccgtttttcactctcattctcttgtgagtgtacagtggaattttccagatatgtaatattggagttgattgaatgcaggagcagatatgagaatccagctgttttctattaagccagaaactaaaaagatttgcaaaaatgtaaaaaaaaaaaatcattatttttactatttattgtttgcttttggaaaaggactataatttttatttaaatcgtattctttttgttaacataagggtttattattggtattttaaattgaatcaataaatgaaattttaaaacaa

SEQ ID NO: 142729 - DNA, 243 bp, Homo sapiens
  Payload ID: 8202
  Gene Symbol: IMMP2L
  Gene Name: inner mitochondrial membrane peptidase subunit 2
  ENST ID: ENST00000437687
  CDS Start-End: 1-243
atggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtaa

SEQ ID NO: 142730 - DNA, 833 bp, Homo sapiens
  Payload ID: 8202
  Gene Symbol: IMMP2L
  Gene Name: inner mitochondrial membrane peptidase subunit 2
  Uniprot ID: Q96T52
  ENST ID: ENST00000452895
  CDS Start-End: 120-647
cccccgggctgagctgcgcagcgggtgcggagggcgggcgcccgggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggca

SEQ ID NO: 142731 - DNA, 761 bp, Homo sapiens
  Payload ID: 8202
  Gene Symbol: IMMP2L
  Gene Name: inner mitochondrial membrane peptidase subunit 2
  ENST ID: ENST00000450877
  CDS Start-End: 112-585
accccccagctccatggggacaaaagctactatgctctggacccttccagacctcactagatttacctcctcatctggctcttcatttgtggtacttttaatgcaccagtaatggtaggagaggacattgaagcaaggagacactttctgaacctctgttgccaaccgagaagagttagcctaagattgaagaagtgcatatctgaggtcaaggacaaggcgggcagtgctcaatgtcatcctttagaacagagggcaggaatcccatctggagagtggaggcaactgaaagagaggtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagta

SEQ ID NO: 142732 - DNA, 421 bp, Homo sapiens
  Payload ID: 8202
  Gene Symbol: IMMP2L
  Gene Name: inner mitochondrial membrane peptidase subunit 2
  ENST ID: ENST00000452753
  CDS Start-End: 185-421
ggtctgcgcggggacttcccccgggctgagctgcgcagcggggttttggccaaattgggcgagggcacaaaataaccacttaccccttctcaccgaggaagagcgggagaaaggtggcctgattcttttgagaagccttcctactccttactcccaaccctgatcaaaggaaaagccatgttgtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattg

SEQ ID NO: 142733 - DNA, 6439 bp, Homo sapiens
  Payload ID: 8203
  Gene Symbol: INO80
  Gene Name: INO80 complex subunit
  Uniprot ID: Q9ULG1
  ENST ID: ENST00000361937
  CDS Start-End: 426-5096
aggcgacgagcagtgagtgtgggcggggtgggggtaagccacccgtgtagcggctcgattgttctggcctggctatggcgcctctcctcccccccgccatggctccccgtgtccctgctccgctcctctcagtgagtgaaagtggccgccgccgccgccggcccagcgcccgcagccgcctcagcgccgccgccatcttggggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaa

SEQ ID NO: 142734 - DNA, 5991 bp, Homo sapiens
  Payload ID: 8203
  Gene Symbol: INO80
  Gene Name: INO80 complex subunit
  Uniprot ID: Q9ULG1
  ENST ID: ENST00000401393
  CDS Start-End: 225-4895
ggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagat

SEQ ID NO: 142735 - DNA, 599 bp, Homo sapiens
  Payload ID: 8203
  Gene Symbol: INO80
  Gene Name: INO80 complex subunit
  ENST ID: ENST00000557849
  CDS Start-End: 1-82
acgagtctgcgacacacatcctacatgggagatgtttgctctgacccacgatctgctgggatactgccatgtcaagtcatagaagggagagagacccaattttcatccacctgctttgtattcctgttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgtta

SEQ ID NO: 142736 - DNA, 5503 bp, Homo sapiens
  Payload ID: 8203
  Gene Symbol: INO80
  Gene Name: INO80 complex subunit
  ENST ID: ENST00000558357
  CDS Start-End: 204-3518
agcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcaga

SEQ ID NO: 142737 - DNA, 566 bp, Homo sapiens
  Payload ID: 8203
  Gene Symbol: INO80
  Gene Name: INO80 complex subunit
  ENST ID: ENST00000559995
  CDS Start-End: 1-239
ctacacttaacaattggcaccaggagtttactagatttgttcctaaatttaaggtgctaccatattggggaaatcctcatgatagaaaagtcatcagaaggttctggagtcagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttag

SEQ ID NO: 142738 - DNA, 4272 bp, Homo sapiens
  Payload ID: 8203
  Gene Symbol: INO80
  Gene Name: INO80 complex subunit
  ENST ID: ENST00000616814
  CDS Start-End: 3694-4272
agcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagcctagccccagactctctggtccggaaacagggcaaaggcaccaacccctctggaggacggtaa

SEQ ID NO: 142739 - DNA, 1261 bp, Homo sapiens
  Payload ID: 8204
  Gene Symbol: INO80B
  Gene Name: INO80 complex subunit B
  Uniprot ID: Q9C086
  ENST ID: ENST00000233331
  CDS Start-End: 95-1165
ggttgttttgctggctccagtttttccgcggggcggaaaaggcgtgtctgcgtgtgtcccaaccatttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcttcggcttgtacagaa

SEQ ID NO: 142740 - DNA, 623 bp, Homo sapiens
  Payload ID: 8204
  Gene Symbol: INO80B
  Gene Name: INO80 complex subunit B
  ENST ID: ENST00000409493
  CDS Start-End: 2-623
catgagtaagctgtggcggcgtgggagcacctctggggctatggaggcccctgagccgggctttccttccacaggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggct

SEQ ID NO: 142741 - DNA, 796 bp, Homo sapiens
  Payload ID: 8204
  Gene Symbol: INO80B
  Gene Name: INO80 complex subunit B
  ENST ID: ENST00000409917
  CDS Start-End: 16-570
tcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgt

SEQ ID NO: 142742 - DNA, 559 bp, Homo sapiens
  Payload ID: 8204
  Gene Symbol: INO80B
  Gene Name: INO80 complex subunit B
  ENST ID: ENST00000431187
  CDS Start-End: 31-559
atttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctgggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaacctt

SEQ ID NO: 142743 - DNA, 617 bp, Homo sapiens
  Payload ID: 8204
  Gene Symbol: INO80B
  Gene Name: INO80 complex subunit B
  ENST ID: ENST00000455562
  CDS Start-End: 1-294
aagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctgggtgaggatctggagatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagt

SEQ ID NO: 142744 - DNA, 974 bp, Homo sapiens
  Payload ID: 8205
  Gene Symbol: INO80C
  Gene Name: INO80 complex subunit C
  Uniprot ID: Q6PI98
  ENST ID: ENST00000334598
  CDS Start-End: 118-696
acagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcattta

SEQ ID NO: 142745 - DNA, 904 bp, Homo sapiens
  Payload ID: 8205
  Gene Symbol: INO80C
  Gene Name: INO80 complex subunit C
  Uniprot ID: Q6PI98
  ENST ID: ENST00000441607
  CDS Start-End: 70-756
agcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacgtgcctttcgccttccaccatgattgtgaggcctccccagccacgtggaactacgtgcctcttgccttccgccatgattgtgaggcctccccagccgcgtggaaatggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaaggg

SEQ ID NO: 142746 - DNA, 594 bp, Homo sapiens
  Payload ID: 8205
  Gene Symbol: INO80C
  Gene Name: INO80 complex subunit C
  ENST ID: ENST00000586489
  CDS Start-End: 154-567
agggcgcgtgcgtaatgtggggcgctgcgcgtgcggtctccgttggggttgaaagacgctgccccgcggagtgaatgactactctttcccttcgtttggacacatgggcttacaacgccttgtgttgtaaggagagaagaagaaggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaa

SEQ ID NO: 142747 - DNA, 3245 bp, Homo sapiens
  Payload ID: 8205
  Gene Symbol: INO80C
  Gene Name: INO80 complex subunit C
  Uniprot ID: Q6PI98
  ENST ID: ENST00000592173
  CDS Start-End: 60-653
aagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgaaccaccaaactgttttccacagaggctgcatcaattgacattcccactagcaatggatgagggttccaatttttccagatgctcaccaacacttgttaattttggttttgttttcattatggccattctggtgggtgtaaagtagcatctcattgtggcttgactgaatttctctaatgagtaatgatgttgagcatttttcatgtgcttattggctatttgtatatctttgttggagaaatatctgttcaagttctttggccattttaaaattgggttgtctttttgttgttgaattgtaaagttctttagatattctgaatactagatccttattaaatatatgatttgaaaatatttttcccattttgaatgttgtcttttcattttttggatagtgtcttttggtgcaccaaacttcaaaaattttttcgaagtccagtttatcaattttttattttgttgcctgtgcttttggtgtcatatccaataagtcattgccaaatccaatgtcacaaatatatttttgctgctttcttgtaagagttatacagttttagctcatatgtttaggtctttgatgcattttgagttaatttttgtatgtagtgtaggataagggtctaacttcattcctttgcatgtaaatattccatttttctggcaccatttgttgtaggaactgtcatttccccattaaatgatttggcatccttgtcagaaatcaattgtccatacatgtgagggtttatttctgggctcccaattctattccattggtctatacatctgttcccatgccagtaccacactgtttgattaatgtcgatttttagtaagttttgaaatcaggaagtgtgaatcctccaactttgttcttttcaagatcattttggttatatgggttaccttaagattccatttgaattttcggatgggtttttctatttttgtaaaaaatatcattgggattttgataggaattgcactgaatctgtagatcgctttgggtagtactatcatattaacaatattaagtcttccaagccataaacatggactgtctttccatttatttagattttctttaatttctttcagcaatgttttgcagtattcagtgtacaagtcttttgcctcctttgttaaatttattcctaaggatgctattctttctgatgctagtaaaatagttttcctaatttcattttcagatcatgcataaccaccaccataaacatgattccaacaccccagagtattccctcagtctgaccttttgtaaagtggtgctttttaaaatttaattttccaattgcttgttgctagtgtatagaaatacgactgatacttttatattggccttgtatcctgagaccctgtaaattcacttattagttctagacagttttaattctttctttccaatctttatgcctattatttctgttttgttttgttttttaaacagggtttggctctgtcacccaggctggagtgcagtggcttgattccaactcactgcaccctcgacctcctgggctcaagtcatcctcccacctcagccttccaagtagctgggactacaagcatgagccaccacacccagctaattttttttcttttctttttctttttttttttttttggagggtgcagggagcagagtcttgctctgttgcccaggctggtctcaaattcctgagctcaagtaattcatacaccttggcctcccaaagtgctaggattacaggcatgagtcaccttgcctgactattacttctttttttgagacagtcttgctctgttgccaggctggagtgcagtggcatgatctcggctcactgcaacctccgcctcatgggttcaagcgattctcctgcctcagcctcccaggtagctgggactacagatgcatgccaccacaccaagctaatttttagatttttagtagagatggggtttcaccatgttggccaggatggtctcgatctcttgacctcatgatccacctgcctcagcctcccaacatgctgggattacaggcgtgagccactgcacccggcctattattcctttttttgccctattgtcccagtggatagtgatgtccagtagagcgttgaatcaaagtggtaaaattgtgcgtccttgccttgttctccacgttaaggtgaaattttgaagatttcattattacatatgatgtaagctgtaggtttttatttatttatttatttagagacagggtcttgctctgtcacccaggctggagtacagtggcatgatccactgtagccttgacctcccagtctcaagcagtcctcccacctcagcctcccaaatagctgagaccacaggcacatgccaccataccctgctaattttttattttttgtagacatggggtcttactatcttgaccaggctggtctcaaactcatgggctcaaatcatcctcctgcctcagcctcccaaagtgctgggattacaggcatgagccactgcacctggcctaactgtgggctttttttgaaatgtctttttcaggttgaggaaggtcccttctattcctagtgtactgagagtttgtatcatgaaaaggtattgaattttgtcaaatgttgttcctgtgtctattgagatggctgtatgggttttctcttttttctgataatgtgatgaattatatggatttattaatattgaaataataaaatgacactgcattcttcgg

SEQ ID NO: 142748 - DNA, 299 bp, Homo sapiens
  Payload ID: 8205
  Gene Symbol: INO80C
  Gene Name: INO80 complex subunit C
  ENST ID: ENST00000589273
  CDS Start-End: 212-299
gaaagacgctgccccgcggagtgaatgactactctttcccttcgtttggacacatgggcttacaacgccttgtgttgtaaggagagaagaagaataagatttacacagagtacaatgcacaaattttcaagaatactggctgaaccacagatcttcaagaatcctgtctcacgcctgtatcccagcactttgagaggccaagggtatcagcatggaagccatgagtgagaataaaatggtgccctctgagtttagcacaggacctgtggaaaaagctgccaaacctttgccatttaagg

SEQ ID NO: 142749 - DNA, 898 bp, Homo sapiens
  Payload ID: 8205
  Gene Symbol: INO80C
  Gene Name: INO80 complex subunit C
  ENST ID: ENST00000586449
  CDS Start-End: 62-331
ggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacgtgcctttcgccttccaccatgattgtgaggcctccccagccacgtggaactgctcattggtggaagggacttgccttgtctcggatgagactttggactgtggacttttgagttaatgctgaaatgagttaagactttgagggactgctgggaaggcatgattgattttaacatgtgaggacatgagatttgggaggggccgggggcggaatgatagtttggctgtgccctcacccaaatctcatcttgaattgtagctcccaaaattcccacatgttgtgggaggaacccggtgggatataattgaatcatgggggcagtttcccccatgctgttctcatggtagtgaataactctcaggaaatctgatggttttataaggggaaacccctttcacttggctttcattctctctcttgcctgctgccacgtaagacgtgcctcttgccttccgccatgattgtgaggcctccccagccgcgtggaaatggtatcagcatggaagccatgagtgagaataaaatggtgccctctgagtttagcacaggacctgtggaaaaagctgccaaacctttgccatttaaggatcccaactttcactctggccacggtggcgcagtagctggcaagaagaacagaacctggaagaacctgaaacaaatcctcgcttctgaaagg

SEQ ID NO: 142750 - DNA, 382 bp, Homo sapiens
  Payload ID: 8205
  Gene Symbol: INO80C
  Gene Name: INO80 complex subunit C
  ENST ID: ENST00000587450
  CDS Start-End: 87-382
atcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacttcagtattgatgctcctccatcctttaagccagctaagaagtattctgatgtttcaggtctgcttgccaactacacagacccccagagcaaactgcggttcagcaccattgaagagttttcctacattcggaggctg

SEQ ID NO: 142751 - DNA, 595 bp, Homo sapiens
  Payload ID: 8205
  Gene Symbol: INO80C
  Gene Name: INO80 complex subunit C
  ENST ID: ENST00000590757
  CDS Start-End: 31-318
tggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcaggccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcattt

SEQ ID NO: 142752 - DNA, 408 bp, Homo sapiens
  Payload ID: 8205
  Gene Symbol: INO80C
  Gene Name: INO80 complex subunit C
  ENST ID: ENST00000591139
  CDS Start-End: 1-408
tcattctctctcttgcctgctgccacgtaagacgtgcctcttgccttccgccatgattgtgaggcctccccagccgcgtggaaatggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcg

SEQ ID NO: 142753 - DNA, 14136 bp, Homo sapiens
  Payload ID: 8206
  Gene Symbol: INO80D
  Gene Name: INO80 complex subunit D
  Uniprot ID: Q53TQ3
  ENST ID: ENST00000403263
  CDS Start-End: 406-3489
ctcttcttgtacagccccggcagccctgccttcttggctggagagtatattcagggatttccccttaataatcaccgaccctgggagcactttttagtttccaaaataaaaatatgatcctcacccctcttgcttgacagggaaaggctctcgccggagcccaggggggagcagtagcagcggcagccgagcttcctagtccattgccagcgcctctcactctgatctgtcagcccagccgagggaacaggggggaaggagaaaaaaaaaagcagctgaaagacaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaaccgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtttggactggtctgaagagagcggagaggaaccagaggactcagagcaggcctcgccctaccaggttgcatggtccatccgggaaaccctcagatatcaaagacatgcgtcagatgatgatgatgcggagagtaggagctccagggtgactcaactttgcacttactttcagcagaaatataagcacctctgccgcctggagcgggcagaatctcgtcaaaagaaatgccggcatacgtttaggaaagctttgctgcaggcggccagtaaagaaccagaatgcactggtcagttaatacaagaactgcggagagctgcatgcagtcgaaccagcataagccggaccaagctgagggaggtggaaccagcagcatgcagtggaaccgtgaagggtgaacagtgcgctaacaaagcccttccattcaccagacattgtttccaacatatcctcttgaaccactctcagcagctcttctcaagttgcacagccaagtttgcagatggacagcagtgctctgtgccagtttttgacattacacatcagacacctctgtgtgaagaacatgccaaaaaaatggataatttcttgagaggagataactcccgtaaagttcagcaccagcagcagaggaaacccaggaaaaaaaccaagcctcctgcactaaccaaaaaacacaagaagaagagaaggcgtggacctcgtcgaccccaaaaacccattccacctgcagtcccccaagggaacctcagcatgcccgccagcgtctcactgccagtggaggcctctcacatccggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaagggaagaatggagacctcctcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactcacactcctcaccccatggaagccattatgatagtgagcatgtgccgtctccctacagtgaccatatcacctctccccacacaacatcgtactctggtgataatatggcagctaccttttcagcagagatgcccatcatggcgcagcacttgctcccaacccaacttgaggtgccacttggaggcgtggtaaaccccagaactcactggggcaatctccctgtcaaccttggagacccctctccatttagcaaccttctcggcgcagatggacatcttctttccacttccctatccacgccacccaccacttcgaactcagagaccacacagcctgccttcgccaccgtgacccccagcagctccagtgtgcttccggggttaccacagaccagcttcagtggcatggggccttctgctgaactaatggcctccacctctcccaagcagcaactccctcagttcagcgcagcctttggccaccagctgagttctcacagtggcattcctaaggacctgcagcccagccacagctctatagcccctcctacaggcttcacagtaacaggtgccacagctacaagtaccaataatgcatcttctccctttccctcccctaactgagggtgtctgtgtgtttgcaggcaggtggggaacccagtgttttctatctttgtttcctctttagcacccctctccccttttcctaaagaagatataacagatggggatcagaggggcaccccccttcccagttcaatgagtggccctgcagtggacctcgctacagtgttcacatgtgctccttagcactggtgctcattccctcctggcaggcccactccgccccagtggtttccttagtggttcagcacagtgactggataggattgatttttagcagcaagtcctagaagtggaagatacctcagaataccagtgccctttactatttcctagtattcagatcagtgctttccattctgttgccaggtttttacataggtggttctagatagaatgatcttattaattgagttcctgtataagagacagcaaatggtgtgtggcaggtcaagattctgacctagcaccaactgctaaacaccacagtgaggccaggattccattcgtaattgtgatcatgtttaactaaaagaaaaaaatgtgtcttttgactgcctgtgagtatgcgtgtgcccacgcgtgtgtttttgtgcagtgcaggaagcagctgtcccattagtttgatttttttttgttctccccttccccctacttaatgagtataaaactcttacttttctcctgtcctacatctcacagtcctaataaggttggtccttcttttcctcaagtttcctgaatagggagggtggtggactggtcgtgtgagtagcacaacctttttctgctaaaagttagcccaagaagaaacagaacatagaaagcttggattcccgtcagtgaggtagggatgtcctaaaaagcttgcctgggatgactgcaggctgccggggttctggggcctgatggtcactttgtcttttcagacatttgtttgtttctaaatccctctctcatggaatacatttgcaagatgtaattaaagaaaatattttgatgtgaaaaagcaggataggtcagatagatttgaaaagatgggatctgtcaactccttgatccatcttttgcttttgaatttttcatgtttacagtagtgattctttggtaagatttgtaaaatgttaagacacttgtagaatcagtgtaccagttgtgaagtgatgtgtaatatctgaaggatacacattttaaagtttctttcaaagcagaatatggaaattagatataaattttattcgccctttggtccttttaaaataattcaagtacttgggtttaagtaaatttgaaaatagctttgggaaatgtttttaaaatgccaggattttaggggttaaagatcatatggggtagtttaggaagtttgtgactatgagatgaatttgtgaggtttcttgcctaccttttttcccccccagagaagggtggaactagattttaaaggcatctctactctgcttttgctgagtagtttcactgtcccttgagataccattggctatttatacctgagtctagtctaattcacatatatatatattttaaaagttgagagaacatacctattgatgtggttcaataattcatttgtcagggaatatttgatcttaattcctttctaataggtagtgattggatgtattttcctacttcctgtatgtaatctctttatgccatgctagttctaaccagtcccttcttttgaaagcttttctttctctgctttttaaaggaatgatggtgatcagcaggcattatgcagataccacgtgcctgaggttatggaggggaaatgtcacatgactgtatgaaatcattatatgccctattttgtatttattgatgtttctttttgtgggccaaaaatatgtttgtaatatatttagtttttttaaaatcatggtaattgattggaagatttatttttaatagctttgccttttttgcagagtgcaaaatttctaaattataacttatgtcataaagcaaaattatatttggtatcaccataaatttctattctgaatggtgagaacagataatttgaatatttctcacctgtgagtctatattagtaagcttttttattttaatgtactgtaatgaagtggtcacgagtagttacctcggctcaaaaatgtcatttagtttgttaaactattttcacaaccatcataagcataactagataactgtccattcccagcagttcagtttagtctccattgtgtatttaaaggttgtcgcagagcagcacattgacttcctcatcagccctttgacaaggaagggaaagtcgtgggtagtcgatttgaactttttctgtctacttgtcccctcatgttagctgcttgaaattcttcagttatgatacaaagctgagtttgcagtaagttgcacattttattgtttgcaattttctgttttatgtgcatttaaaagcccttctctgctttctagtaaggaggcatgaaattatcaggaatgttgctagttacagcttcacaccaaaaactttgagtaaatacattttcgtttggatgcccatgatgaaagctgaggaaagtggttgaggaattatcaacaacaaacttttcctcttattttatctagttcaaaacagatatcaaagtttgcaatttgctttgctcttgctgtttcttatgagtccctttttggaagagaggagaacatctataagcccagagagatctgtgtttttcttttacttaatagagccattctcgtctattagtaggaactttgctattaatatgtatagaaaggaatgaagtggcttttactccagaaatatgaaaattagtatcttttaaaatagcacttatgctatcacaaggcaatactggaatgaaaaacaaatcttatataaggtcctaaataggtagaaactagcttttattctagtgttgaacccaggagaaatagtggcaaagaagtttcactctgtttctgcagttctttgggactatttataaaggccagttagattgtgttactgtgatttaatttacaaagttgctgcagttaatggatacattctgtgctctgagaatctgaattccattctaatgtgtgatattcactggctatgatcagtagtatctgaagaaaagatgggctttttctcctttactctctctacataattattaatattattttaattaaagtacttaagacattgttttttcttctgtaaaaatggcttagcaatttgcacatctgggtaggttatgtagctagtaaacaactcaatagtaagtagcaattatacttaacccaccaagtgacagactatgcaatggaaaaattttctaattatcgtcacatagcttagacagcaaaggattattttctctggtgacctaccatgtgtgatataactgctttataaatgacttcctgagcaatttcatgttggcaggcagtgtggtgtgtctagtgcccctctatgagaagactataatttaatcagaaacaaatagtaggcatggggagcaagttggaaagtgaggttattattttttttccttaaaattggtgttactgtctttagtggcttgaggctaaagaaagctgatactttatctttgccaaataattatttataagatttatttttaaataagcccaatctctcacctgcagttaagaatcatcattttctgtgactgacactaaagctcttccttatcagagcttgttctcaatctgtgatcacagtccacagtggcaaagacaactctttgattaggaaggaaaccatgtttgggatgcacagaggtgccctgtccatacggttttcttcttacatgaaagaattgacctttctgttgacctataccattctgtttttataaagtgggattagaatttgagcatatctagtaaatgccgtgtggtcagtccgctgatgcttgcccgccgtctttgccgtgccttggcatcctaggggtgctggtgatggtcagtgggcatcatcggtcagcagtgcacgtgtaaggcaatctcctctcctccaggttagttcagaaggtcgctatgggttggtattgcaaaaagatgagtatatgaacactaaacttattaagaggtttgaaattcattaaaaattagttttcagtttcttcatctttcttttcagacttctttaaaaatactgttcttaatctggtatatatagaaatctaatattatggtcttctaaatggtcaacagaactctccagtttaatgaggcaatttagaggattccttgaaagaaaatttcatcatactgaacagtcctcatttgtatctcttttgttaccagtatttacattgttccaaggatttttttcctgacaaaaaatatatttctcgggagtggagagttttttatatatatatatgaaagaacatagatgtttccccccgcccaatacattaactgaatcttcactggcattctgtagaaaagttaaaacagtttaataatgtcttaacatctttatacattttcctatattctggaggaaaccagaatcatgtttagtagattaaagtaacattttaaatactacctttccaataatttgtaataaaataccagtgaaggacatgtttggatatctgttaagcatttttccctgactaatgaattaggaaagaaaacataaaacataaatgaatagttatgtctcttctaataaacagtgtcattaatgctgcagttgtgggtcaaacttagggagccttatttctaaatagcaaaaattctgttttcacttcagcccttatttttttttgttagtttttctctgcactgtgatacagagctaataagaggaaatgtgacgtttcagagagagagcaagcaaattgggtatgacttttttaccctatgttccccaatactggggatgtttggctactttgaacagcagtttttagtgatctaaagtttagatcaatactcgtataagagaaaaatctaactctcagtgagctccatagggcagcacagctttccatcttctctttcgccttcttgcgtctgcccaccacagtcccgaagaatgcacacgcacatatgatctgtacccatcccgcccgaagagtcatagaatcctcttctttcacttgtttcttttttcttcgtttgtttgtttttgtttgtttgttttttaagctggggaccactgaagtaagctctgtatgcacccaaagttccccttggaaaaattttcaacacgcagtgcagaaggctccagtgcagctaaatgccacaccattggttctacctgggggaatagactgatttgccctaaaatgactccaacctgcatcattaaggtacagttggctccagtggattagtgctgaaatgatgggaagtctgacacttgttgacattgtcttcatctgtttggaagggttgaatctgttcctctcaacagtgatagttcttttcactgtatagtattgagtatgtctcagggattccttgtggaaattagggcagtttttaaaataagaaaatagttttaaaagaaactaaaggtgactcatcattgaagagagcggaagaaagaggaaacatttggttttgtagcccacagtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttttgacaaaacaaactagtgaagcacctttttacactggatctctgccgtgtcaaggtgtatagctatcctttgctaccttgcagatatataaaataaaaggatatcctggggcctcaaaatgtagaacacctttagaccatttataactgttcctagaactgttgagaatcatgttctttagtaaatgatctgtggtttacacttaagatggctagaagcttagttacagggtacatagaaatacatagatcaagtaaaactccaactactgtagctggaatttgtaaactaagtttgtaagacctcttttatttcctatggagttattctttaatttacagtttattctgtaagttgggaagtaaaatagagaaaataataaatctagatgttctcagtgtcttattcaggaactttttatccctcctcactaaggaattcccactgtgactttaaaatagaactaaattacttgtgtgcatgtatatgtctgtattttttacacacatgcaaaaatatacattgggggcacgtgtgtgagagatatgaatgtgtgcttatataaaaatagataaaggtaaccgaatgtattgtagaaacatgatttatttagttgagggtattggagttactttctcattgtctctgttgtataaatacaccaaattaatcattatgttatcttatgttaaaaggctagctctgatatcatgtgcattttatgttaacctttggattaacttatattatgctatgttcataaaatgacatgagaaacaggaggttctaagatcagcctctcactttcgagcataaaaataagagagggagacagacagccccagacatgagctgtgtttatctattgtggtgatgggaccacagatctattgaatcttttttatgttaattatagatttctttatattcgagtaagaaaatattgttgatcatcttttcttggtgaagttaagaaaaagtataggcctttcataaacaatttttggaaggggctgctttgtttaaggagttggtgggatcatttcaccgtgcatatttcaaagctggggtgatttcatttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttcttttttttttttttttgcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagta

SEQ ID NO: 142754 - DNA, 1664 bp, Homo sapiens
  Payload ID: 8206
  Gene Symbol: INO80D
  Gene Name: INO80 complex subunit D
  ENST ID: ENST00000424117
  CDS Start-End: 348-1664
acaatctgcttcatcctgattctgcggcattccaaactgtggtatccttgggggttctcttaacattgctatggtgcagaagatttaaaatcagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaaccgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtttggactggtctgaagagagcggagaggaaccagaggactcagagcaggcctcgccctaccaggttgcatggtccatccgggaaaccctcagatatcaaagacatgcgtcagatgatgatgatgcggagagtaggagctccagggtgactcaactttgcacttactttcagcagaaatataagcacctctgccgcctggagcgggcagaatctcgtcaaaagaaatgccggcatacgtttaggaaagctttgctgcaggcggccagtaaagaaccagaatgcactggtcagttaatacaagaactgcggagagctgcatgcagtcgaaccagcataagccggaccaagctgagggaggtggaaccagcagcatgcagtggaaccgtgaagggtgaacagtgcgctaacaaagcccttccattcaccagacattgtttccaacatatcctcttgaaccactctcagcagctcttctcaagttgcacagccaagtttgcagatggacagcagtgctctgtgccagtttttgacattacacatcagacacctctgtgtgaagaacatgccaaaaaaatggataatttcttgagaggagataactcccgtaaagttcagcaccagcagcagaggaaacccaggaaaaaaaccaagcctcctgcactaacc

SEQ ID NO: 142755 - DNA, 753 bp, Homo sapiens
  Payload ID: 8206
  Gene Symbol: INO80D
  Gene Name: INO80 complex subunit D
  ENST ID: ENST00000414320
  CDS Start-End: 643-753
ctggcccccctttgctctgcctccaagatggtaggaaagttgtcgtttcggagggcagaggagcagctctctggtgttatgtcctcgcagtgcctgtagtggtgctgtaggaggctgctgcctcttcttgtacagccccggcagccctgccttcttggctggagagtatattcagggatttccccttaataatcaccgaccctgggagcactttttagtttccaaaataaaaatatgatcctcacccctcttgcttgacagggaaaggctctcgccggagcccaggggggagcagtagcagcggcagccgagcttcctagtccattgccagcgcctctcactctgatctgtcagcccagccgagggaacaggggggaaggagaaaaaaaaaagcagctgaaagatcttcactctcacccaggctggagtccagaggtgtgatctcggctcactgcaacctctgtcttccgggttcaagtgattctcctgcctcagcctcccaagtggctgggattacagacaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatc

SEQ ID NO: 142756 - DNA, 1489 bp, Homo sapiens
  Payload ID: 8207
  Gene Symbol: INO80E
  Gene Name: INO80 complex subunit E
  ENST ID: ENST00000304516
  CDS Start-End: 597-1214
gaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggcc

SEQ ID NO: 142757 - DNA, 883 bp, Homo sapiens
  Payload ID: 8207
  Gene Symbol: INO80E
  Gene Name: INO80 complex subunit E
  Uniprot ID: Q8NBZ0
  ENST ID: ENST00000567065
  CDS Start-End: 66-479
cggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccacccc

SEQ ID NO: 142758 - DNA, 880 bp, Homo sapiens
  Payload ID: 8207
  Gene Symbol: INO80E
  Gene Name: INO80 complex subunit E
  ENST ID: ENST00000567705
  CDS Start-End: 62-745
acggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaagg

SEQ ID NO: 142759 - DNA, 1412 bp, Homo sapiens
  Payload ID: 8207
  Gene Symbol: INO80E
  Gene Name: INO80 complex subunit E
  Uniprot ID: Q8NBZ0
  ENST ID: ENST00000562441
  CDS Start-End: 66-479
cggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaagagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatga

SEQ ID NO: 142760 - DNA, 2103 bp, Homo sapiens
  Payload ID: 8207
  Gene Symbol: INO80E
  Gene Name: INO80 complex subunit E
  Uniprot ID: Q8NBZ0
  ENST ID: ENST00000563197
  CDS Start-End: 1018-1752
agcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtt

SEQ ID NO: 142761 - DNA, 255 bp, Homo sapiens
  Payload ID: 8207
  Gene Symbol: INO80E
  Gene Name: INO80 complex subunit E
  ENST ID: ENST00000562291
  CDS Start-End: 1-255
cctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatgttcagcgatgcaggtagcggggacgatgccttggatggagacgatgacctggtgatcgacatccc

SEQ ID NO: 142762 - DNA, 1926 bp, Homo sapiens
  Payload ID: 8207
  Gene Symbol: INO80E
  Gene Name: INO80 complex subunit E
  ENST ID: ENST00000567987
  CDS Start-End: 61-627
cggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggggagcgggagtccctgaagggccaggggagtgaggagatggaaggaagggagtccaagcagaggaaggatagctgtgaagacagaagcagtggcggcattgtgcggagaatagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtt

SEQ ID NO: 142763 - DNA, 625 bp, Homo sapiens
  Payload ID: 8207
  Gene Symbol: INO80E
  Gene Name: INO80 complex subunit E
  ENST ID: ENST00000567254
  CDS Start-End: 68-589
agcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggagg

SEQ ID NO: 142764 - DNA, 515 bp, Homo sapiens
  Payload ID: 8207
  Gene Symbol: INO80E
  Gene Name: INO80 complex subunit E
  Uniprot ID: Q8NBZ0
  ENST ID: ENST00000620599
  CDS Start-End: 102-515
acagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctga

SEQ ID NO: 142765 - DNA, 2040 bp, Homo sapiens
  Payload ID: 8208
  Gene Symbol: INO80B-WBP1
  Gene Name: INO80B-WBP1 readthrough (NMD candidate)
  ENST ID: ENST00000452361
  CDS Start-End: 30-1121
tttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctaccttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagct

SEQ ID NO: 142766 - DNA, 1668 bp, Homo sapiens
  Payload ID: 8208
  Gene Symbol: INO80B-WBP1
  Gene Name: INO80B-WBP1 readthrough (NMD candidate)
  ENST ID: ENST00000441673
  CDS Start-End: 18-809
tttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccacttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacac

SEQ ID NO: 142767 - DNA, 1185 bp, Homo sapiens
  Payload ID: 8209
  Gene Symbol: ITPA
  Gene Name: inosine triphosphatase (nucleoside triphosphate pyrophosphatase)
  Uniprot ID: Q9BY32
  ENST ID: ENST00000380113
  CDS Start-End: 193-777
gcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaccctgcccca

SEQ ID NO: 142768 - DNA, 897 bp, Homo sapiens
  Payload ID: 8209
  Gene Symbol: ITPA
  Gene Name: inosine triphosphatase (nucleoside triphosphate pyrophosphatase)
  Uniprot ID: Q9BY32
  ENST ID: ENST00000399838
  CDS Start-End: 28-489
ggctcagctgggtaaccggggatcaccatggcggcctcattggtggggaagaagatcgtgtttgtaacggggaacgccaagaagctggaggaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaccctgcccca

SEQ ID NO: 142769 - DNA, 729 bp, Homo sapiens
  Payload ID: 8209
  Gene Symbol: ITPA
  Gene Name: inosine triphosphatase (nucleoside triphosphate pyrophosphatase)
  Uniprot ID: Q9BY32
  ENST ID: ENST00000455664
  CDS Start-End: 40-573
ggagttttcggtggctcagctgggtaaccggggatcaccatggcggcctcattggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagct

SEQ ID NO: 142770 - DNA, 4401 bp, Homo sapiens
  Payload ID: 8210
  Gene Symbol: IPPK
  Gene Name: inositol 1,3,4,5,6-pentakisphosphate 2-kinase
  Uniprot ID: Q9H8X2
  ENST ID: ENST00000287996
  CDS Start-End: 278-1753
tctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccacattgtacgtgtcacttttatttggcattttatacttaactagttgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 142771 - DNA, 882 bp, Homo sapiens
  Payload ID: 8210
  Gene Symbol: IPPK
  Gene Name: inositol 1,3,4,5,6-pentakisphosphate 2-kinase
  ENST ID: ENST00000375522
  CDS Start-End: 86-577
accctgagtccggggctcgggcctcagggcccgcgagtctgcgaagccagccctttcagtaggagccttcgctgccaaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattc

SEQ ID NO: 142772 - DNA, 6807 bp, Homo sapiens
  Payload ID: 8211
  Gene Symbol: ITPRIP
  Gene Name: inositol 1,4,5-trisphosphate receptor interacting protein
  Uniprot ID: Q8IWB1
  ENST ID: ENST00000278071
  CDS Start-End: 454-2097
gtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccaaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgcaaggagtagaaatggtcactgtttgtttttaacttcaggaaatctgtgaggctcccagggcagagttggggacaggggggtggatttcctattgacaaagcagaagctttcactccctttttattcttacactttcaggagactttaaaaaataacaaaacagaacatttctaccctgtctttgaggcaacttgtgtgctgcccgcagggctccagaaagggcctttgaaagctggctgtagggtggattccagcctaagaccttatttcacagagctaatgtcagcgagaaatataggagctggaactaacaggaagcttttgggttttaaagaaagagattgtattttaaatagaggattttgagtcctctaggggactttggcctttccactaaggacaaccctgccctctttccccagagtctctttcccaaggatgcttgactttccccagcaactgctcacttgctttgcaaaataacaagggtgaaatgaatagagttggcccctaggccaagaggctggttatgttggggaagggccttatatcctcaaaagctctagcccctctgcatgcctggctgaagcacagcccccgttgagaacctgggggtggagctctggttcatcatcaagggtgtcatccgaatcacccagacaacctggtccattgccccgaccccgccttgaacctacatggtgctcagaatccagtctggagtggtcaggctaggctcgatttttaaagatttcccccaagtgactgatggtacccctagctgaggaagccctctcactttctttcttaatggaaagttaaagaaaacccaagtggactactttccctacagatctattggaagatagatagacctgggaaaagccaatgagcctgcttggaatctgtggtctaagtggcatcagctacaccacaagcttctcatgagggcacccacattcacgctagtgccgtaagcctcagagagagggtgggaaggcataagatggtgagcccttctcccaagcaggtcatgaatagtccacaagcatttgtcaggagcctaacgtgcatgagacattgtggaagatgggaaaatgaataggaccaagcctgttccctaggagaggcagcagaaggtggccttccaagtactgagctattccaagtgtgaccctgcactacacatacgggtgtcacctgggggcagcttcctgggccgtgtcacagactccagtgggatcctgagaagttaggtagaagaatctgcacttcaccaagttccccacctgattctggatgtccaagaaccactggtacctgggctgattagggaaggcctcatggtggggcgctgccagatagagactctgaaaaatgaccaggactgtggccaggaaagacattccagccagaagcatggagtgagggtgggaagcacctactgtatggcaggcaccgttccgcacacacatttgttaatgcacacagttccatgtcagtcctatgatgtaggtgctattcttatcctccctgctttccagataaggaaacaggcactgaaggggcaactgacttacctactgtcacagtggtaagtagcacagcccagattccaacccaggcagtcctggtgtacatgttggcatatactgagaagtcgtagcaaatgaggttgaaaagataagagtggggctgaaccatgcaaagccttgaatgctaatacaaggtaaatttggacctcacaacaagcagaggtgggccattggcgggttttgagtgagacagtaacttgattcacccccaaactaaggagtccttatctatgtgatcagtgccatccatgtcctgtgctgtagggtacatggccggcttcccgagcagggttggtggcagctggcagtggttggtgaatgtccaggaagtcttaactcaagccaccccaaggctgtgattcagaacattttcgtggtccgtctcatctccacctcacgggacagagctggaaggctgtttggtttggccagcgaccgaaagcagagggagccaagagtcacagagtgaagggcaatgtgtgccttcaacagggccctccctctccgccccactctgccttgccccacccctgtccctgggaagggcatcttttagagttaacttttctcattgccatccaaaaatagcttgcttgtttaactagtttgttgtttaaaaaataaacataaaagcaataatacagtcataattttaaaattcaagtactaacaggaaaattaagtaacagactaacggtcccacttctgacttcttagtccactccccagagataaccaatatgaagtttttggtgtatccttccaaaatttttctgtgtatgtgtcacatgtatgtatatatatatgcatccttttagtccttttttacataaatggcatcataccgact

SEQ ID NO: 142773 - DNA, 4093 bp, Homo sapiens
  Payload ID: 8211
  Gene Symbol: ITPRIP
  Gene Name: inositol 1,4,5-trisphosphate receptor interacting protein
  Uniprot ID: Q8IWB1
  ENST ID: ENST00000337478
  CDS Start-End: 173-1816
agcgggggcatcgccgcccgcgcccctctaagtgccgggccgcaagctccaccgcagccgcctgcaagcagcggcgcctcggccctcgacctgcgcgcaaagcctgtgctggagccgtcctcccgcggcggggaccgggaccggggacccaagccaatcgaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccaaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttgcaaggagtagaaa

SEQ ID NO: 142774 - DNA, 3981 bp, Homo sapiens
  Payload ID: 8211
  Gene Symbol: ITPRIP
  Gene Name: inositol 1,4,5-trisphosphate receptor interacting protein
  Uniprot ID: Q8IWB1
  ENST ID: ENST00000358187
  CDS Start-End: 74-1717
gaacagtctgggatttctttcactgtgtggggcctagaatctcaggaagccaggacgtgggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccaaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttg

SEQ ID NO: 142775 - DNA, 796 bp, Homo sapiens
  Payload ID: 8211
  Gene Symbol: ITPRIP
  Gene Name: inositol 1,4,5-trisphosphate receptor interacting protein
  ENST ID: ENST00000458723
  CDS Start-End: 454-796
gtgcgctcttcaggacagcagaggtcggttggaggtctgcattctctgccgacttgggccccaacttccccatcaggtcactgctccctcctctgaggtctggacaaaggacaaggctgtagggacctagactgtcctagacggggaggacatctatcctcagtggtctttccagcagtttgtttggagctgctcatcctgatcttttggctgactctggcagagggaaagtcagatttgaggcctgagctctaacaggcatccagagaggaaggaagggcccaccccgtgacatcagtgaaacggaagcaccctgcaggtgacatcactgttgctcagggcaacgcctccaccctaaggcggacggggaggtgaaaaatcggcctcaagtgtgagacgcatgttgaagggaagggacatagaaggtgtaacgttcacaggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagt

SEQ ID NO: 142776 - DNA, 4295 bp, Homo sapiens
  Payload ID: 8212
  Gene Symbol: ITPRIPL1
  Gene Name: inositol 1,4,5-trisphosphate receptor interacting protein-like 1
  Uniprot ID: Q6GPH6
  ENST ID: ENST00000361124
  CDS Start-End: 386-2077
ggcaggttcagggctttctggctataaaagggagcctctgggatcagcaggtcatatctggtgcccatggttgactgaggagtcgggtgaggccaccctaccacaagggtccccctccccatcctacacaggaatgaaaacagtcccatgtacactttctggaagcctaaataccacccacaccatgtggaaggaaagcaggagagagactgagtggcacatcctttcgccctcttttctctcgaacctcctcccaggccgaccacccttgctgtgtccaagccaagctctgtgggctttctgttcctcctgagtagctgattttcagaatttggggtaccagggctctggggaatgtgagctagagagcagataagtctggaagatgaccactgactcctactctcctacttctccagatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggctacaaaagtgtttacttttcagatatatcagtggtatatgtgaccttcaccttgccagtgggggctatgatgagacaccttaaggagcgtgtgaggtggtcatgaggatgggcataatgaccctgcagggcctagtcaaggatgggtcatctgaggttttcttctgctaactttcatcatgacccaaagaaggtccagggaaacggatgttatgggaggatcttgctgctaaggaggtgagatccagagggtcactgtgaagttgtgtttttgtatcaacactcgaagtgagagaaccagagaataccttcattccagcttattcctttttgtgattgacttccagtatgttccttgtgaattggtttccttgttgaactgttagcttaattctcatccgagctggtggcactccattttatcccaaatactgtgatgggcaacttctcataatttacgatctaatttttcaaaccttcactattttgaaaatataaccaaggccggttgcggtggctcacgcctgttaatcccagcactttggggggccgaggtgggtgtatcgcctgagttcaggagttcaagaccaccccgggcaacatggtgaaaccccatctctgctaaaatacacaaaattagccgggcatggtggcgcgcacctgtagtcccagctacttgggaggctgaggcacgagaatcacttaagccccagtggtggaggttgcagtgagccgagatcgcaccactacacttcagcttggactacagagtgagaatctgtctcaaaaaaaaaaaaattatatatatatatatatatatatatatatatatatatatatatatctccaagatgtttacattccattttcttaacttagccctattttcatatgacaatagagttgtttttatgcatctgaaaaaactacctaatttattcgcattgattcacaaatattaagtcaatagtaacctgtctcataattgagataatgtatttaccataataatgaaatggttaacatctgatgacctttttaaggtgcctggaggcaacattataaaggccttcacaaggacaatctttttgggggctctgagatgaataattactttgttgcttgtggggagccacttgttgagtgtaaagaaggtttagctgccatgtttagctgtgctttttctgtctggccatgcctcctttgtatttttttttttttttttcaaaaatgacaaagggattacttgaactgtgtttgtggttttgaaagagaggtcatcacaatccaggctcactgccaggtttgtataggaaaggattgggaaacagtccaactctaaaattgtgattctagagatataattggtgtatttttcccttttttcaaaaccatgggatgctgaggaggagtgttaagaaatgcaactatagttatgggtgtgattgttttggaaacgccaatgctgttctatctgcactgccaagaagatctgctggggagggtaacctgtccccactgaacttgacctcagcagggatcagatgctggcccttataggcttcagtcatagaatacacaccctctcctccagcaaaaataaattaaaaatgtcccaaagccaggtgcagtggctcacacctgtaatcccagcactctgggaggctgaggtgggaagatcacttgagcccaggagttcaagaccagcctgggcaacatgtcgcaatcccgtctctacaaaaaattagctgggcatggtggcatatacctgtgatccctgctactctggaggttgaggcggaaagactgcttgagcccaggaggtcagggctgtagtgagctatgatagtgtcactgtgctccagcgaccctgggcaaaaaagtgagaccgcgtctcaaaaaaaaaaaaaaaaaaaaaaaaaaaaaaggttcccagaagctgatgccagtcaatcattggggctcccagtgcacaatagctactgtgttcctgtgttgcctgcatctgtcaggtaccgctttcaatgcaagatgcaatcatggttgcttccctgctgatgggattttggtgttttagcaacattcacatactttttgtttagaaaattatttgctgatgttttaagttaaagtcaataaaggaggctattttctgtatacattggaa

SEQ ID NO: 142777 - DNA, 1946 bp, Homo sapiens
  Payload ID: 8212
  Gene Symbol: ITPRIPL1
  Gene Name: inositol 1,4,5-trisphosphate receptor interacting protein-like 1
  Uniprot ID: Q6GPH6
  ENST ID: ENST00000439118
  CDS Start-End: 252-1919
gctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacgggctcctagagagggcggggagacgaagcaaggccaagttccaaagggaggataggcccagctggcttcagcgtccacacggcatagtccttcatgaatgttgatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacaga

SEQ ID NO: 142778 - DNA, 1788 bp, Homo sapiens
  Payload ID: 8212
  Gene Symbol: ITPRIPL1
  Gene Name: inositol 1,4,5-trisphosphate receptor interacting protein-like 1
  ENST ID: ENST00000420728
  CDS Start-End: 1-1763
agaggaaaggtgtcacccaggcaggttcagggctttctggctataaaagggagcctctgggatcagcaggtcatatctggtgcccatggttgactgaggagtcggatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaaca

SEQ ID NO: 142779 - DNA, 790 bp, Homo sapiens
  Payload ID: 8212
  Gene Symbol: ITPRIPL1
  Gene Name: inositol 1,4,5-trisphosphate receptor interacting protein-like 1
  ENST ID: ENST00000420176
  CDS Start-End: 250-790
gctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacgatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagt

SEQ ID NO: 142780 - DNA, 1947 bp, Homo sapiens
  Payload ID: 8212
  Gene Symbol: ITPRIPL1
  Gene Name: inositol 1,4,5-trisphosphate receptor interacting protein-like 1
  Uniprot ID: Q6GPH6
  ENST ID: ENST00000536814
  CDS Start-End: 250-1893
gctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacgatgcagaggcctccatggctgtgataagcctgctgttcttggcagtgatgtatgttgttcaccaccctctgatggtcagtgatcggatggacctggacacattagccaggagtcggcagctggagaagcgaatgagtgaggagatgcgcctgctagagatggagtttgaagagagaaagcgagccgctgagcagaggcagaaggcagagaacttctggacaggagacacatccagtgaccagttagtgctggggaagaaagacatggggtggccgttccaggccgatggccaggaagggcctctgggctggatgctgggaaacctgtggaacactggcctcttttgcctttttctcgtctttgagctcctgcgacagaacatgcagcatgaaccggcctttgattccagcagtgaggaggaggaggaggaagtccgtgttgtccctgtcacctcttacaactggcttactgacttcccctcccaggaggccctggactccttttacaaacactatgtccaaaatgccatccgtgacctgccctgcacctgtgagtttgtggagagttttgtggatgatctcattgaggcctgtcgggtgctcagccgccaagaggctcacccacaattggaagactgcctgggcatcggggctgcctttgagaaatggggaaccctccatgagacccagaaatttgatatcctggtgcccattgtccccccacagggcaccatgtttgtcctggagatgagggacccagccctgggccgccgctgtggctgtgtgctggtggagtcagaatgtgtgtgcaagcgtgagaaactcctaggggacgtgctgtgcctggtgcaccaccacagggacccctcggcagtcttggggaagtgtagtagctccatcaaggcagctctctgcaccggcttccacctagacgtgtgcaagactgtgcagtggttccggaacatgatgggcaatgcctgggcccttgtggcccacaagtatgactttaaactcagtctcccaccgtctaccacctcctgcaagctccggctggactatcgctcaggccgctttctctcaatccacttggtcctgggggtgcaacgagaagacaccttggtctacctggtgagtcaggctcctgaccaggagcagctcaccagtgtggactggcctgagtcctttgtggcctgtgagcacctgttcctgaagctggtggggcgctttgcccccgagaacacctgtcacctcaagtgcctccagatcattttaagtctccggcagcatcagagcttaccccatggagcatcccgccccatcctcacttcttaccattttaaaacagctctcatgcacctcttgctacggctgcccctcacggactgggcccacaacatgctctctcagcggctccaggacattctctggttcttgggccgtggcctccagcaaaggtccctccatcatttcctcattggtaacaattttctgcccctgaccatcccaatccctaagacatttaggaatgctgagccggtcaatctcttccaacacctggtgctcaaccccaaggcacattcacaggcagtggaagagttccaaaaccttctgacccaggtgaaaactctgcctcatgccccactggctgcagcaccttgatgtaaagaccattaaaaaaaaaacagaggaaggtatttctaattccttgggcta

SEQ ID NO: 142781 - DNA, 7247 bp, Homo sapiens
  Payload ID: 8213
  Gene Symbol: ITPRIPL2
  Gene Name: inositol 1,4,5-trisphosphate receptor interacting protein-like 2
  Uniprot ID: Q3MIP1
  ENST ID: ENST00000381440
  CDS Start-End: 80-1687
ctgtgcgcatgctgggcttgggtcgccgccggggcttgccccctgggctgctcggccaccgccgccccgggcgcccggcatgtcggtgcactacaccctcaatctacgcgtcttctggcccctggtgaccggcctgtgcaccgccctggtgtgcctctaccatgtcctgcggggaagcgggggcgcccgggccgagcccgccgacggcgtggatggcggcttcccgttgcttaaggtggccgtcctgctcctcctcagctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgaggtgcgcctgtctccgcacgtgttgggccacagcaaggcgcacgtgagccggatcgtgggcgagctggtgcgggctggccgcgcccgggggtcccccggtctcattcctgggggagcgctggccttggccttccgcggagacttcatccaggtgggcagcgcctacgagcaacataaaatccgccggcccgacagcttcgacgtgctggtgccactgcgcctcccgccgcttgtggcgctggagccacggagcctgggcgaggagccagcgctggccccggccttccgcggctgcttcttgtgcgccctcaaggcaccaccctcaccatcgggggcctcggggggccactggcttcgggactgcaaaccctttgctgatgccttctgcgtggatgtgcgcgggcggcgtcacctctctgctactctggtgctgcgctggttccagtcgcatctgcagcgctccttggccactgtgcgttacagcctggaggggcgctgtcgggtcaccttgaccccaggtggcctggaacagccccccaccttacacatcttgccctgccgcactgactacggctgctgccgcctttctatggctgtgcgtctcatccccgctgtccatctgggagatggggtcttccttgtggcgccaccaccgccacccttgcccagcgcgcccctgttggagctccctgagggcctgcgtgcggaggcactgtggggtgtgaacacagcacgccaggagcagaagctgctgagttggctgcaggaacgggcagctccaggtgcctgctacctcaagtgcctgcagttgcttaaggctctgcgcgatctgggggcccgtgggctggactcagcggccgccacccagtggggacgcatcctatcctcatatgtgctcaagacagtgctgctggcagtgctgctgcgcaagggggcccctgggcaaggctgggacgaggagcacctgggaaggtgtttggaggagttggtgcagttccttagggactgcctgctgcgacgccatacgctcttccactgcgtcctgggccctggtggggcggctgccgaggtgggtcccctgcccaaggcactgagggaagccgccccagttgacctcctggccgctttcgacgggcacgcccgggaacttgcagcagcgcggttgctgtccacgtggcaaaggctgccccagcttctccgggcctacgggggtccccgctaccttgccaggtgccccccaccccggagtcagcgcacccagggcttccttgaaggtgaaccgtaaaccctgacagcacccccacctgaccaaatgctcctaaagcctttcccactgggtgggggtgggaatggcggtgaagccagttaaatgcaagattgcagaaggcattggaaaatttggtggctgccacaagctttagtggcttaaatatcaccttctcgcttcacagtccagtataatatgacatcttcacacccactagagtgtcctgggcaaaccatgggaagacatccaacaggagacccaagaattggttcaaatattgttctgtgtagacggattctgtagaaggatgtggcttttagagaagtccagtagaagaagcaagaactagctgcagggaaagttccttctgtcggtttttagacacagatctctctgcccaaattaaaaaaaaacaaaacaaaacactaaagtttttgacacaattacttgctaggtactgggttcctgattgtctttaaaaagaaaaatctgaatctttatttgcaactggaattgaagttctattttaggggctaatgtttagaggaacataatttccactgttcaaattaatattaatgtatttttaaaatggtgcaatcacaggtgtttgacaagattgtcaacaagttaagtcacatagatggaaaggcaatcgagagttggttagagaagcttccagagaaaatagcactttatattgatcaattcactcattttgtggtaattgctagcaccaagcattgcatctgaaagggaagccagttatatttattattaaatgtacaaccttgaaaagcagccagcatgcttgcctaactaacatcgccgcaggccacaagctgggatatgtacctgtccgtcaacatccattcattaaactacctactaccagccagagatgtctggaaccaaagtagcaaccaaatacatattcaagacaacactggtgaaggcataaaacatgttggctttggagaaagatgtgttttaggctttgcctgtaaaggtgtttctccaaggctggctgctggctggagacagaaaacttttttgttttaaggtttttagcaaactccttcacaaagagatttctttctgagcttaatgagctaatgaagaggaaatgcctgctgcttagcatgtggtttgtgctgggtctctaaccattgatggttcttccttgtccaggcagtcttacgtggtccaagagacctgttgattcagcacaggtcttgcaaaacatttcacttatagttcagtatcttgggctctgtgcttgaagatcagttactccctggtcgtgggcagaggagacaaattaggaaaagagcaagggagacagcccttgacggcagtctgtctcttttctctttaggtgtcagtatcaccaggttgggtgtattttgcagctgggaggagccggtcctggaattcttccttgttctcccaaatttataacagtcctcaattgcagtttaagttcagcatggcccctcatctgcttgcctgattggaaatgcagccagtccaagtgttacaaattgggatttttttgttttctaaataaaaacatgtacttcctcagactcttaaagctaaaatttggaagacagaaatgcctatgtgaatagaatcattgttgaagttctgagctcttttgagggaactctataagccttctttctttaggggatccacttgcctgctgtgggaaatcatagtgagtgatttacaggaatccttctcctccaagctgcattggcttcttatatcctttgcgaccttgggctgaaagagaaacagctgcaaatgttgtgctgtctctttgaggttgtcttggggacagttccccgcaaaggtcattcctagcttttgaggtcaatgttgggtcataaggtactgcattgtgcaaagaagtcagtctgctaactttatgcaaagatagaaactgcacggtattttttaaaattagtttttaaaataaatgccaagagtagatcttatatatatatatatgtatacatattttatatatatatatatttccatactcaaccacaacttcctctgtactcattgtttactacagtgggggacatcaagggttggaaggattataaagctttaaggctgggcgtggtggctcacgcctgtaatcccagcactttgggaggcgaggtgggcggatcacctgaggtcaggagttcaagaccagcctagccaacatagtgaaactctgtctctactaaaaaatacaaaaattagctgggcgtggtggcgggcgcctgtaatcccagatactcgggaggctaaggcaggagaatcacttgaacccgggaggtgaaggttgcagagagccaagatcacaccactgcactccagcctgggtgaccgagcgagactccgtctcaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgcctggctaatatatatatatatatatatatattttttttttttttttttagtagagatggggtttcatcatgttggccaggctggtctcgaactcctgacctcaggtgatctacctgcctcggcctcccaaagtgcagggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaa

SEQ ID NO: 142782 - DNA, 2008 bp, Homo sapiens
  Payload ID: 8213
  Gene Symbol: ITPRIPL2
  Gene Name: inositol 1,4,5-trisphosphate receptor interacting protein-like 2
  ENST ID: ENST00000566735
  CDS Start-End: 1-384
gtcgctttaaggcggaggcccgggagggggccgacccggctcgccagctccacgctcggctccagactccggcatttcctccccgctagctggcgcggcctcgcctccccctcggaagaggaaactcccggggtccgagtaacagggtcaggcgcggagaggagcggcgggagagccaggagggccgcccaggctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgaggtgcgcctgtctccgcacgtgttgggccacagcaaggcgcacgtgagccggatcgtgggcgagctggtgcgggctggccgcgcccgggggtcccccggtctcattcctgggggagcgctggccttggccttccgcggagacttcatccaggtgggcagcgcctacgagcaacataaaatccgccggcccgacagcttcgacgtgctggtgccactgcgcctcccgccgcttgtggcgctggagccacggagcctgggcgaggagccagcgctggccccggccttccgcggctgcttcttgtgcgccctcaaggcaccaccctcaccatcgggggcctcggggggccactggcttcgggactgcaaaccctttgctgatgccttctgcgtggatgtgcgcgggcggcgtcacctctctgctactctggtgctgcgctggttccagtcgcatctgcagcgctccttggccactgtgcgttacagcctggaggggcgctgtcgggtcaccttgaccccaggtggcctggaacagccccccaccttacacatcttgccctgccgcactgactacggctgctgccgcctttctatggctgtgcgtctcatccccgctgtccatctgggagatggggtcttccttgtggcgccaccaccgccacccttgcccagcgcgcccctgttggagctccctgagggcctgcgtgcggaggcactgtggggtgtgaacacagcacgccaggagcagaagctgctgagttggctgcaggaacgggcagctccaggtgcctgctacctcaagtgcctgcagttgcttaaggctctgcgcgatctgggggcccgtgggctggactcagcggccgccacccagtggggacgcatcctatcctcatatgtgctcaagacagtgctgctggcagtgctgctgcgcaagggggcccctgggcaaggctgggacgaggagcacctgggaaggtgtttggaggagttggtgcagttccttagggactgcctgctgcgacgccatacgctcttccactgcgtcctgggccctggtggggcggctgccgaggtgggtcccctgcccaaggcactgagggaagccgccccagttgacctcctggccgctttcgacgggcacgcccgggaacttgcagcagcgcggttgctgtccacgtggcaaaggctgccccagcttctccgggcctacgggggtccccgctaccttgccaggtgccccccaccccggagtcagcgcacccagggcttccttgaaggtgaaccgtaaaccctgacagcacccccacctgaccaaatgctcctaaagcctttcccactgggtgggggtgggaatggcggtgaagccagttaaatgcaagattgcagaaggcattggaaaatttggtggctgccacaagctttagtggcttaaatatcaccttctcgcttcacagtccagtataatatgacatcttcacacccactagagtgtcctgggcaaaccatgggaagacatccaacaggagacccaagaattggttcaaatattgttctgtgtagacggattctgtagaaggatgtggcttttagagaagtccagtagaagaagcaagaactagctgcagggaaagttccttctgtcggtttttagacacagatctctctgcccaaatt

SEQ ID NO: 142783 - DNA, 10197 bp, Homo sapiens
  Payload ID: 8214
  Gene Symbol: ITPR1
  Gene Name: inositol 1,4,5-trisphosphate receptor, type 1
  Uniprot ID: Q14643
  ENST ID: ENST00000302640
  CDS Start-End: 351-8582
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 142784 - DNA, 10242 bp, Homo sapiens
  Payload ID: 8214
  Gene Symbol: ITPR1
  Gene Name: inositol 1,4,5-trisphosphate receptor, type 1
  Uniprot ID: Q14643
  ENST ID: ENST00000354582
  CDS Start-End: 351-8627
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 142785 - DNA, 9762 bp, Homo sapiens
  Payload ID: 8214
  Gene Symbol: ITPR1
  Gene Name: inositol 1,4,5-trisphosphate receptor, type 1
  Uniprot ID: Q14643
  ENST ID: ENST00000357086
  CDS Start-End: 349-8481
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtga

SEQ ID NO: 142786 - DNA, 9717 bp, Homo sapiens
  Payload ID: 8214
  Gene Symbol: ITPR1
  Gene Name: inositol 1,4,5-trisphosphate receptor, type 1
  Uniprot ID: Q14643
  ENST ID: ENST00000456211
  CDS Start-End: 349-8436
agtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtga

SEQ ID NO: 142787 - DNA, 9513 bp, Homo sapiens
  Payload ID: 8214
  Gene Symbol: ITPR1
  Gene Name: inositol 1,4,5-trisphosphate receptor, type 1
  Uniprot ID: Q14643
  ENST ID: ENST00000443694
  CDS Start-End: 1-8232
atgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtga

SEQ ID NO: 142788 - DNA, 4131 bp, Homo sapiens
  Payload ID: 8214
  Gene Symbol: ITPR1
  Gene Name: inositol 1,4,5-trisphosphate receptor, type 1
  ENST ID: ENST00000544951
  CDS Start-End: 351-2516
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaa

SEQ ID NO: 142789 - DNA, 581 bp, Homo sapiens
  Payload ID: 8215
  Gene Symbol: ITPR2
  Gene Name: inositol 1,4,5-trisphosphate receptor, type 2
  Uniprot ID: Q14571
  ENST ID: ENST00000242737
  CDS Start-End: 1-546
atgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatgatgcaagcttctggatttaatttggttaataaattatctggtgatatcttccttt

SEQ ID NO: 142790 - DNA, 11405 bp, Homo sapiens
  Payload ID: 8215
  Gene Symbol: ITPR2
  Gene Name: inositol 1,4,5-trisphosphate receptor, type 2
  Uniprot ID: Q14571
  ENST ID: ENST00000381340
  CDS Start-End: 418-8523
cttccagctcccgccgggcggctgtgacggccgcagcgggtcgcagagcagggagtggacacggagtggggagcggagagggaaggaggaggaggaggagcaaaggtgttggagagaaaacttcagaaaggaacaggaaacctgccggggaggcggcggcggctgcggcttctctgggcgcctgggctgcgctcttcgcggggtgtccgcagctgcggcttggccccggtctggcttccccggcgcgcacgcacggctgagccgcgacgctcagtggctcgggccgtgccctccgccgcggctcttggccgctgtagtcccgcgatccgatccgcttctgccgcggcggctccctggagagagggcggcgagggcgcagggaagaagagggacgtccactgtggaacatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcacgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgccagtatgttttctgagttaaaataacacttttagatgagaaaatgcttgtatcatacagggctataatataaataaataaattgtatgtatgcaaaa

SEQ ID NO: 142791 - DNA, 2577 bp, Homo sapiens
  Payload ID: 8215
  Gene Symbol: ITPR2
  Gene Name: inositol 1,4,5-trisphosphate receptor, type 2
  ENST ID: ENST00000451599
  CDS Start-End: 1-309
aacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagaattttggtcatggggtgaccctaaaacggctctgcaggactaaacttaaatgagacataatcagtgcaaagcaaccaacggcatgaaagatgtttgatttcattgtggcatgcatgtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacatt

SEQ ID NO: 142792 - DNA, 540 bp, Homo sapiens
  Payload ID: 8215
  Gene Symbol: ITPR2
  Gene Name: inositol 1,4,5-trisphosphate receptor, type 2
  ENST ID: ENST00000545235
  CDS Start-End: 6-245
gcagcatgactgagaaaatgtccagcttcctctacataggggacatcgtgtccctgtacgcggagggctcggtcaacggcttcatcagcaccttgggactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatattgttgtaggagataaagttgttttgatgcctgtgaatgcagggcagccactacatgccagcaacatagagcttcttgat

SEQ ID NO: 142793 - DNA, 9870 bp, Homo sapiens
  Payload ID: 8216
  Gene Symbol: ITPR3
  Gene Name: inositol 1,4,5-trisphosphate receptor, type 3
  Uniprot ID: Q14573
  ENST ID: ENST00000374316
  CDS Start-End: 1061-9076
ggcaccctatcttaggcgttcaaataaaggactaggaagcaaacacccaagcaccggggaacagaacagaaagaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccagggcgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaatgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccgctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggcccgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaa

SEQ ID NO: 142794 - DNA, 9029 bp, Homo sapiens
  Payload ID: 8216
  Gene Symbol: ITPR3
  Gene Name: inositol 1,4,5-trisphosphate receptor, type 3
  Uniprot ID: Q14573
  ENST ID: ENST00000605930
  CDS Start-End: 225-8240
ggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggctggtggatgaccgctgtgtggtggagcccgcggccggggacctggacaacccccctaagaagttccgtgactgcctcttcaaggtgtgccccatgaaccgctactcggcccagaagcagtactggaaggccaagcagactaagcaggacaaggagaagatcgctgatgtggtgttgctgcagaagctgcagcatgcggcgcagatggagcagaagcaaaatgacacggagaacaagaaggtgcatggggatgtcgtgaagtatggcagtgtgatccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtggtcgtgggggacaaggtgatcctgaatcctgtcaatgccgggcagcctctgcatgccagcaattacgagctcagcgacaacgccggctgcaaggaggtcaattctgtgaactgcaacaccagctggaagatcaacctgtttatgcagtttcgggaccacctggaggaggtgttgaaagggggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtggtccaccacgacccctgccgtggaggagctgggcactggaatggcttgtaccgcttcaagcacctggctacaggcaactacctggctgctgaggagaaccccagttacaaaggtgatgcctcagatcccaaggcagcaggaatgggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggaactcgtacgtccggctgcggcacctctgcaccaacacgtggattcagagcaccaatgtgcccattgacatcgaggaggagcggcccatccggctcatgctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggttcctggactacctctctgacctgtgtgtgtccaaccacatcgccatccccgtcacccaagagctcatctgcaagtgtgtgctggaccccaagaacagtgacattctcatccggaccgagcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccacgacgagaatgtgctcagctactacaggtaccagctgaagctctttgcccgcatgtgcttggaccgccagtacttggccatcgacgagatctcccagcagctgggcgtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggactatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcagttcatcctcaatgtccgcctggattaccgcatatcctacctgctgtctgtcttcaagaaggagtttgtggaggtgtttcccatgcaggacagtggggctgatggcacagcccctgccttcgactctaccactgccaacatgaacctggatcgcatcggggagcaggcggaggccatgtttggagtggggaagacaagcagcatgctggaggtggatgacgagggcggccgcatgttcctgcgcgtgctcatccacctcaccatgcacgactatgcgccgctggtctcgggtgccctgcagctgctcttcaagcacttcagccagcgccaggaggccatgcacaccttcaagcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagagcgtcccacggacgaggagggctttctgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgctgcacaaacacctgcacctcttcctcacgccagggctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtgaaaatggcctatgtgaacttcgtgaaccactgctacgtggacacggaggtggagatgaaggagatctacaccagcaaccacatctggacgctctttgagaacttcaccctggacatggcccgggtctgcagcaagcgtgagaagcgcgtggctgaccccaccttggagaagtacgtgctgagcgttgtgctggacaccatcaacgccttcttcagctccccattctctgagaacagcacttccctgcagacacaccagacgattgtggtgcagctgctgcagtctaccacacgcctcctcgagtgtccgtggctacagcagcagcacaagggctccgtggaggcctgcatccggaccctcgccatggtggccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagctgatccagcacaccaaggacctcatggagtcggaggagaagctgtgcatcaaggtgctgcggaccctgcagcagatgctgctcaagaagaccaagtacggggaccggggcaaccagctgcgcaagatgctgctgcaaaactacctccagaaccggaagtccacctcgcggggggaccttcccgaccccataggcactggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggccgcgtggcctccttctcgatacctggctcctcatcccgctactcgctgggccccagcctgcgccgggggcacgaggtgagcgaacgtgtgcagagcagtgagatgggcacatccgtgctcatcatgcagcccatcctgcgctttctgcagctgctgtgtgagaaccacaaccgggacctgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccagacttgcattgtgactcacgagtccaatggcatagacatcatcaccgcactgatcctcaatgacatcagccccctgtgcaagtaccgcatggatctggtgctgcagctcaaggacaatgcctccaagctgctcctggctctgatggagagccggcatgacagtgaaaatgctgagcgaatcctcatcagcctgcggccccaggagctggtggacgtcatcaagaaggcctacctgcaggaggaagagcgtgagaactcggaggtgagcccacgtgaagtgggccataacatctatatcctggcgctgcagctctccaggcacaataaacagctgcagcacctgctgaagccggtgaagcgcattcaagaggaggaggccgagggtatctcttccatgctcagcctcaacaacaagcagctgtcacagatgctcaagtcctcagcgccagcacaggaggaggaggaagaccccctggcctactatgagaaccacacgtcccagatcgagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagcatgccgctgatctactggttctcccgccgcatgaccctgtggggcagcatctccttcaacctggccgtgtttatcaacatcatcattgccttcttctacccttacatggagggcgcgtccacaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctgctctttgacctcatctaccgcgaggagacgctgttcaacgtcatcaagagtgtgacccgcaatggccgctccatcctgctgacagccctgctggccctcatcctggtctacctcttctccatcgtcggcttcctcttcctcaaggatgacttcattctcgaggtcgaccggctgcccaacaaccactccacagccagccccctggggatgccacatggagctgctgcatttgtggacacctgcagtggggacaagatggactgtgtctcagggctctcggtgcctgaggtcctggaagaggacagggagctggacagcacagagcgggcctgtgacactctgttgatgtgcatcgtcactgtcatgaaccatgggctacgcaacggtggtggcgtgggcgacattctccgcaagccctccaaagatgagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgtt

SEQ ID NO: 142795 - DNA, 4456 bp, Homo sapiens
  Payload ID: 8217
  Gene Symbol: IP6K1
  Gene Name: inositol hexakisphosphate kinase 1
  Uniprot ID: Q92551
  ENST ID: ENST00000321599
  CDS Start-End: 303-1628
gttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccatgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctcgattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 142796 - DNA, 4117 bp, Homo sapiens
  Payload ID: 8217
  Gene Symbol: IP6K1
  Gene Name: inositol hexakisphosphate kinase 1
  Uniprot ID: Q92551
  ENST ID: ENST00000395238
  CDS Start-End: 460-1290
ccgccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccatgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctcgattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgg

SEQ ID NO: 142797 - DNA, 1815 bp, Homo sapiens
  Payload ID: 8217
  Gene Symbol: IP6K1
  Gene Name: inositol hexakisphosphate kinase 1
  ENST ID: ENST00000468463
  CDS Start-End: 316-1140
ccgccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctca

SEQ ID NO: 142798 - DNA, 1260 bp, Homo sapiens
  Payload ID: 8217
  Gene Symbol: IP6K1
  Gene Name: inositol hexakisphosphate kinase 1
  Uniprot ID: Q92551
  ENST ID: ENST00000460540
  CDS Start-End: 336-1166
agccgccatcttgttgttgatccgtacccagtgggcagcgccgggagctggaccaagcggccggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaa

SEQ ID NO: 142799 - DNA, 4806 bp, Homo sapiens
  Payload ID: 8217
  Gene Symbol: IP6K1
  Gene Name: inositol hexakisphosphate kinase 1
  Uniprot ID: Q92551
  ENST ID: ENST00000613416
  CDS Start-End: 654-1979
agatgctggcaccgaagccggggggacagccggtgtggaggacggagagcgccagtgcctgagggttggccggctagtagcgggaaaccagcttctctgaccgaagctctggactccgctgatccggagcgctaaagtgtgtccggtgccaccctgatgctctcctgggagttatgttgctcctggctgagaaatagacttacctctttcttagatagcgttcctgcgagtgattttcaggacgctggatgctaagactagacgaagcaagccaaagcccccgcgagccaggcaggccggtgtcacggccctatgattatggcaagggggaccctctgcctggctgctgcttcctgagacccgttcggaacctcacgtgtacctcgaagctcaccgttttcctcgcaaagaacctggttaaatgtccataatggctgagttttattttggaacataatttctttggttcttcaccaccactttttggagagtggtaatgtcttcctctttttgctttaggagaaagacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccatgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctcgattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgg

SEQ ID NO: 142800 - DNA, 1775 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000328631
  CDS Start-End: 225-1505
aggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctacgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgta

SEQ ID NO: 142801 - DNA, 1185 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000340879
  CDS Start-End: 191-484
cattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaa

SEQ ID NO: 142802 - DNA, 571 bp, Homo sapiens
  Payload ID: 8218
  Gene Symbol: IP6K2
  Gene Name: inositol hexakisphosphate kinase 2
  ENST ID: ENST00000453202
  CDS Start-End: 152-544
ctgccggagaaggcgggggccaagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtg

SEQ ID NO: 142803 - DNA, 1260 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000416707
  CDS Start-End: 175-387
gagaaacaataggacggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtctcttgatcacagtaacccatagtcccccactggggggacggtgggggaagactttgggaggattttacccagaatacttgccgcctgctttttgtcctccaggaaaccagaagcccgggtaattaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaaga

SEQ ID NO: 142804 - DNA, 1124 bp, Homo sapiens
  Payload ID: 8218
  Gene Symbol: IP6K2
  Gene Name: inositol hexakisphosphate kinase 2
  ENST ID: ENST00000417896
  CDS Start-End: 178-570
cgagagaaacaataggacggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaa

SEQ ID NO: 142805 - DNA, 560 bp, Homo sapiens
  Payload ID: 8218
  Gene Symbol: IP6K2
  Gene Name: inositol hexakisphosphate kinase 2
  ENST ID: ENST00000434860
  CDS Start-End: 399-560
cattttggtgcgagagaaacaataggacggaaacgccgaggaacccggctgaggcggcaggtctttgggctgcctctgcccttcgtagattctctgctgggcctttggaactaacacagcaacttccagggtctcatgttgaagactttatggggtctcgctctgtcacccaggctggagtacagtcatgtgatcacggctcactgcagccttgacctcccaggctccagtgacccttccatctcagcctcccaagtagctgggaccacagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagacc

SEQ ID NO: 142806 - DNA, 750 bp, Homo sapiens
  Payload ID: 8218
  Gene Symbol: IP6K2
  Gene Name: inositol hexakisphosphate kinase 2
  ENST ID: ENST00000412795
  CDS Start-End: 186-572
ggtgcagggggcggggctcggcctggccgcagccattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtctcttgatcacagtaacccatagtcccccactggggggacggtgggggaagactttgggaggattttacccagaatacttgccgcctgctttttgtcctccaggaaaccagaagcccgggacaaagccaaaggccccttgttagctggccatccctgccccattttttcccctggtcctttcccc

SEQ ID NO: 142807 - DNA, 579 bp, Homo sapiens
  Payload ID: 8218
  Gene Symbol: IP6K2
  Gene Name: inositol hexakisphosphate kinase 2
  ENST ID: ENST00000443853
  CDS Start-End: 279-579
ttttggtgcgagagaaacaataggacggaaacgccgaggaacccggctgaggcggcaggtctttgggctgcctctgcccttcgtagattctctgctgggcctttggaactaacacagcaacttccagggtctcatgttgaagactttatggagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagata

SEQ ID NO: 142808 - DNA, 1673 bp, Homo sapiens
  Payload ID: 8218
  Gene Symbol: IP6K2
  Gene Name: inositol hexakisphosphate kinase 2
  ENST ID: ENST00000449610
  CDS Start-End: 167-559
ggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaa

SEQ ID NO: 142809 - DNA, 537 bp, Homo sapiens
  Payload ID: 8218
  Gene Symbol: IP6K2
  Gene Name: inositol hexakisphosphate kinase 2
  ENST ID: ENST00000440424
  CDS Start-End: 374-537
ggaaacgccgaggaacccggctgaggcggcaggtctttgggctgcctctgcccttcgtagattctctgctgggcctttggaactaacacagcaacttccagggtctcatgttgaagactttatggggtctcgctctgtcacccaggctggagtacagtcatgtgatcacggctcactgcagccttgacctcccaggctccagtgacccttccatctcagcctcccaagtagctgggaccacagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccct

SEQ ID NO: 142810 - DNA, 689 bp, Homo sapiens
  Payload ID: 8218
  Gene Symbol: IP6K2
  Gene Name: inositol hexakisphosphate kinase 2
  ENST ID: ENST00000450045
  CDS Start-End: 69-524
cccttccaagagggatgccagagccttctgtaagctcctgagatgtcactggtatctaggcaacagggatgagcctgaacctccctgaggccagcttactgagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggc

SEQ ID NO: 142811 - DNA, 543 bp, Homo sapiens
  Payload ID: 8218
  Gene Symbol: IP6K2
  Gene Name: inositol hexakisphosphate kinase 2
  ENST ID: ENST00000412850
  CDS Start-End: 283-543
attttggtgcgagagaaacaataggacggaaacgccgaggaacccggctgaggcggcaggtctttgggctgcctctgcccttcgtagattctctgctgggcctttggaactaacacagcaacttccagggtctcatgttgaagactttatggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatat

SEQ ID NO: 142812 - DNA, 792 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000413298
  CDS Start-End: 303-596
ggtgcgagagaaacaataggacggaaacgccgaggaacccggctgaggcggcagggtctcgctctgtcacccaggctggagtacagtcatgtgatcacggctcactgcagccttgacctcccaggctccagtgacccttccatctcagcctcccaagtagctgggaccacagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacc

SEQ ID NO: 142813 - DNA, 2490 bp, Homo sapiens
  Payload ID: 8218
  Gene Symbol: IP6K2
  Gene Name: inositol hexakisphosphate kinase 2
  ENST ID: ENST00000433104
  CDS Start-End: 1108-1500
agataagcaaaccagcactttagagtataacatccagtgatggtcaaactgttcactttcattctgaaactgctggcgtgggcacgagtggacagctgcagtacacactcccatgtctgctgtgagctgagtcttggcctgtggccagctgtgtacgaagatggcaggcttatgggaggatgtccactcccactgaccctggcattgcctgagtcccttgcctacctgggctgggccaagacccaactgcaatcaattgtctggggtccactcgctgctgtggtctctgcctttgtgctcacctcaagactcttgccccctccacctttggaggtcctctttggggatcagaggcccatctctgccaggggcctgaagacctacatcctggagggtacctcccttgggagatcaatcccctgtcctcctgctctttgctccatgagaaggatccacctacgacctccagtcctcaaaccaaccagcccaaggaacatctcaccgattttaaatcgggctgatgtgtgcagaacagactgaaggcatcaggggcagcaagaggagaccaggaggcagctgtgacattgcactcaagagaaatggtggcagtttggactcagtgaaagctatgctgacattcactcaggtatcctgctgtccatcggcccgcagctagtctatccacccaaccgcccgtcagacctccggcccaccctcccagacggaggacaatgctccgccctctctggccccgcccccagtcaccgccttttccggaagctgctgcagcgaatcctggcaccctagcaacagcgcctttcaggctgtccagtccgcgtgcgcagctcctaggacgagccaatagtgaggggcaccgggagcgaggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatga

SEQ ID NO: 142814 - DNA, 1565 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000446860
  CDS Start-End: 151-717
ttttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactga

SEQ ID NO: 142815 - DNA, 1309 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000432678
  CDS Start-End: 253-516
gagccaatagtgaggggcaccgggagcgaggtgcagggggcggggctcggcctggccgcagccattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggggacatcagcagccaccagcatggtggggtctttgttggggagtgggggagtcttttgtaaatcaagacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatgg

SEQ ID NO: 142816 - DNA, 576 bp, Homo sapiens
  Payload ID: 8218
  Gene Symbol: IP6K2
  Gene Name: inositol hexakisphosphate kinase 2
  ENST ID: ENST00000437427
  CDS Start-End: 304-576
ttttggtgcgagagaaacaataggacggaaacgccgaggaacccggctgaggcggcagggtctcgctctgtcacccaggctggagtacagtcatgtgatcacggctcactgcagccttgacctcccaggctccagtgacccttccatctcagcctcccaagtagctgggaccacagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggg

SEQ ID NO: 142817 - DNA, 568 bp, Homo sapiens
  Payload ID: 8218
  Gene Symbol: IP6K2
  Gene Name: inositol hexakisphosphate kinase 2
  ENST ID: ENST00000424035
  CDS Start-End: 284-568
attttggtgcgagagaaacaataggacggaaacgccgaggaacccggctgaggcggcaggattgtattcgttctcatatatcaactaagctacactagcagaaaacttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgc

SEQ ID NO: 142818 - DNA, 539 bp, Homo sapiens
  Payload ID: 8218
  Gene Symbol: IP6K2
  Gene Name: inositol hexakisphosphate kinase 2
  ENST ID: ENST00000455545
  CDS Start-End: 95-539
agcttcctaggtgacagacaggtacactgtatgctagccctgtatctgtctgagcagtggaatgtgccaggaaagaaggagcaaccactgactgatgaacctttgccagtctcccttccaagagggatgccagagccttctagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgt

SEQ ID NO: 142819 - DNA, 973 bp, Homo sapiens
  Payload ID: 8218
  Gene Symbol: IP6K2
  Gene Name: inositol hexakisphosphate kinase 2
  ENST ID: ENST00000443964
  CDS Start-End: 129-698
ggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagcc

SEQ ID NO: 142820 - DNA, 580 bp, Homo sapiens
  Payload ID: 8218
  Gene Symbol: IP6K2
  Gene Name: inositol hexakisphosphate kinase 2
  ENST ID: ENST00000449563
  CDS Start-End: 189-580
ttttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaagctgttttgatatttgttaagtttgcagatgagtttggggcctctggcaacatagagactaaggaactgggtgtggtatctgtgcgctttgaagaagatgaagacaggaacttgtgtctaatagcatatccattgaaaggggaccatggaattgtggacattgtagataattcagactgtgaaccaaaaag

SEQ ID NO: 142821 - DNA, 631 bp, Homo sapiens
  Payload ID: 8218
  Gene Symbol: IP6K2
  Gene Name: inositol hexakisphosphate kinase 2
  ENST ID: ENST00000454335
  CDS Start-End: 211-631
ggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcat

SEQ ID NO: 142822 - DNA, 2174 bp, Homo sapiens
  Payload ID: 8218
  Gene Symbol: IP6K2
  Gene Name: inositol hexakisphosphate kinase 2
  Uniprot ID: Q9UHH9
  ENST ID: ENST00000431721
  CDS Start-End: 239-796
cattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaa

SEQ ID NO: 142823 - DNA, 553 bp, Homo sapiens
  Payload ID: 8218
  Gene Symbol: IP6K2
  Gene Name: inositol hexakisphosphate kinase 2
  ENST ID: ENST00000413654
  CDS Start-End: 240-553
gaggcggcaggtaaagctcgcgtcctatggccctagtgcccgaggagctttgagggagattttttcaggctactgggaaacgggatctctgatcattggagtctcccagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtga

SEQ ID NO: 142824 - DNA, 2610 bp, Homo sapiens
  Payload ID: 8219
  Gene Symbol: IP6K3
  Gene Name: inositol hexakisphosphate kinase 3
  Uniprot ID: Q96PC2
  ENST ID: ENST00000293756
  CDS Start-End: 328-1560
agacctcccgcaccagggctctggtgaacagcaaatgctccacgctgggacgggccattgcctgatgcctgtacatggtgggcactgagagacaagattcctgggccctgccttccatacactccccacgatctcggaggaagctctgaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgacttgaagcagccttgaagagtgagttcatgagctcatggtttttctccttgtatggactgctcgctccaagggcaggcagagctcatgaatgcctcttatcttcctaagcggagttttaggtgacacaggatgaagcagaagagatctacccatctcatctgctctgcacccagcttctaagtggacaaagccaagcccaggcatgagctctggcaaagcaagaccccagattctccatttttgcctgtggaaaggagggtccctttacaggcttttttttcctttttttcccccaaaatctcttaaaatgaggaatctcttagcagactttggagttccccattctgccacattctgaccatgagacgcggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtatggaaacctattacgatgcccttgagtcaagcactgagatacgttacccaattagggaaataaatttgttaataaaattgctgaggtc

SEQ ID NO: 142825 - DNA, 2012 bp, Homo sapiens
  Payload ID: 8219
  Gene Symbol: IP6K3
  Gene Name: inositol hexakisphosphate kinase 3
  Uniprot ID: Q96PC2
  ENST ID: ENST00000451316
  CDS Start-End: 457-1689
agacctcccgcaccagggctctggtgaacagcaaatgctccacgctgggacgggccattgcctgatgcctgtacatggtgggcactgagagacaagattcctgggccctgccttccatacactccccacgatctcggaggaagctctggctggctacctggtagacaatcgctgccaatccgtccaagtccaggggcaagggagtttccactgctgtgccacaggctgcactgaaggcccaggggtcttccctgctcacactgcgctctctgaggagaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatct

SEQ ID NO: 142826 - DNA, 546 bp, Homo sapiens
  Payload ID: 8219
  Gene Symbol: IP6K3
  Gene Name: inositol hexakisphosphate kinase 3
  ENST ID: ENST00000634274
  CDS Start-End: 317-546
ttgcctgatgcctgtacatggtgggcactgagagacaagattcctgggccctgccttccatacactccccacgatctcggaggaagctctggctggccaggagtctgccccacggaggtgccagcgtcttcgtggagaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacag

SEQ ID NO: 142827 - DNA, 7199 bp, Homo sapiens
  Payload ID: 8220
  Gene Symbol: IMPAD1
  Gene Name: inositol monophosphatase domain containing 1
  Uniprot ID: Q9NX62
  ENST ID: ENST00000262644
  CDS Start-End: 260-1339
ggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttagtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 142828 - DNA, 584 bp, Homo sapiens
  Payload ID: 8220
  Gene Symbol: IMPAD1
  Gene Name: inositol monophosphatase domain containing 1
  ENST ID: ENST00000520392
  CDS Start-End: 1-248
taactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagccagaaataagctggtgatgcagctggtttcattactagccatggtggactatatcttgccctgtagtgagtgactgctaaaacaacaatctaattgggataattctgacttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgac

SEQ ID NO: 142829 - DNA, 487 bp, Homo sapiens
  Payload ID: 8220
  Gene Symbol: IMPAD1
  Gene Name: inositol monophosphatase domain containing 1
  ENST ID: ENST00000517461
  CDS Start-End: 1-249
cgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggctggggcaggagaatcgcttgaacccgagaggtggaggttgcagtgagccaagatcgcgctgttgcactccagcctgagtgacagagcgagactctgtctcaaaaaataaataaataaataaaaataaacaataagttactttgcaatgtatttttgttctgagtttaatgtttatacagttactttaaaatttttttaatttgaaataattttaaacttaagcagttgcagagactgcagcaagctcctgcacactccatcctgctattttaacaggatactta

SEQ ID NO: 142830 - DNA, 6133 bp, Homo sapiens
  Payload ID: 8221
  Gene Symbol: IPMK
  Gene Name: inositol polyphosphate multikinase
  Uniprot ID: Q8NFU5
  ENST ID: ENST00000373935
  CDS Start-End: 324-1574
gccgtcagggccccagggagcgcggggcgccgctgctgctgttcttcggctcggttctgtctaccgggcagcgccggggccggcggctgcggcggcagaggaacaggagccgggagccgcgttccgccgagagttgggcagaggagcgcccgcgccccggcggcgtcatgggccccctccccgcgcttcagagggcaccagccgcgggaacccccgggcctcctcgcgcccgagcctgagcgaccctcgggttctccggcgccccctccctcgccctattttttttcctactctcgctgccgttaccgcttctgctctccgttatggcaacagagccaccatcccccctccgggtcgaggcgccgggccccccagaaatgcggacctcaccggcgatcgagtccacccctgagggcaccccgcagccggcgggcggcagactccgcttcctcaacggctgcgtgcccctctcgcatcaggtggccgggcacatgtacgggaaggacaaagtgggtatactgcaacatccagatggcacagttttgaaacagttacaaccacctccaaggggcccaagagagctggaattctataatatggtttatgctgctgactgttttgatggtgttcttctagagctacgaaaatatttgccaaaatattatggcatctggtcacctcccactgcaccaaacgatttatacctaaaactggaagatgtgacccataaatttaataagccctgtataatggatgtaaagatagggcaaaaaagctatgatccttttgcctcatctgagaagattcagcaacaggtcagcaagtacccattaatggaagagattgggttcttggtgcttggcatgagggtttatcatgttcattccgatagctatgagacagaaaaccagcattacggaagaagcttaacaaaagaaactataaaggatggagtctccagattttttcataatgggtactgcttaagaaaagatgctgttgctgccagtattcagaagattgagaaaattctgcagtggtttgaaaaccagaagcagcttaatttttacgcaagttcattactctttgtttatgaaggttcatctcagccaaccactacaaaattgaatgacagaactttggcagaaaagtttttgtccaaaggacaactgtcagacacagaagtactagagtacaataataactttcatgtgttaagttccacagctaatggaaaaatagagtcttcagtgggcaaaagcttgtccaagatgtatgcgcgtcacaggaaaatatatacaaaaaagcatcacagtcagacttcattgaaagttgaaaatctggagcaagacaatgggtggaaaagcatgtcacaggaacatttaaatggaaatgtactttcccaactggaaaaagttttctaccatcttcccactggttgccaagagattgctgaagtagaagtgcgaatgatagattttgctcatgtgttccctagcaacacaatagatgagggatatgtttatgggctaaagcatttaatttctgtacttcgaagtattttagacaattgaatcctctgttgcagtctttttaaggggtgggccaatcataatgaagaggggcagtcaatatctgcacctttaatgctatgtaaaaaatttgtattatgagtcgacattttatttgtctttatacttttggaagaatggttaacttttttataatcttactcaggaaaactaactatttgttcattagaaaactatgaagaataaagaaacttaggaatgttaagcagggaatgtggtggtacatggcttaaacatcttttttggctcaagcaaaatgcaaaccattattcagtcattaagagtttagttagctttctgtagccaattcatgaaatctctgtccacccagccttgacaatgagccatatctaaaatattacattattagaacacctaccaaaatctcgaaagcacaggttgatgtccttagtattgctatgtatgaagttactaaaactggagaaaattctacttcagaaataagtactgtttaggttttatattaaaagttcagaccagcatatcaaagggtgctccttagtgaaatgatttagaattgttgcattccaaaagcaggttttctctttaatttttacatctctctctcaaaatattatacttcatgaaaaagacaattgatgtggatgacaacaacaaagtcttgaaattaagggcacactaattgtccttactggggttaggggaagagagatattattttcaaggaacaaaatattttcctttacaatctttcattcatgagaaaattggaatataaatttattacattgtgaaagtatcataaaccatatacctttgtatctaaatgcagcttcaaaaaagtaaataattgaagttttatttctcctctaaataacttgaatttttttctttaaaaatttatgtatttatatgtccccatttagttaagtggtagtgtaaatgtatgttgttaaaaacagtttctcagaattatagtaagcaatgaaagacaatatctaattaggttgttatcaaaaatactgtgtgtaaattagtccgtaatatagggtttggtgcgtatctatattcatgcttctatttcactcttcctcaaaacagttttatattatgttgaccagtgaaattgtaacttaatttcatggggacaggggcagtgctacagttcctggaaaaattagatttgtattatctttgtttcacacccaccaccttaaaaaaaaatcaactagttatttgtcatttaaaacatttaaaactttgagtcttcaaatacatttgatgttaatgctgccattacttgcacttccattcactaataacatttctaggtagttatcagttttgtcatattcctggaaaatattttggggttgtaaattctttctcctctttttcttctggagttacaaattgaatttttaaatccgagcacctttattgtggtgtggagaaaattatcacaattttatgtttattttaccttctcagccttctctgagggcactttgcaaatacctgagtccaaacagaagtaccaactaaatgctctatgaactctatccttagtaaatctattaaacctgaataatttaaaagatcatgttcattttgtaatagcaaaatttgattttaattttttatttagaattggtgtatttatcatagggacttccaatttttcttcactttttgaatggatattggctatagttttatgttttaacgggaatgaatttcaagtcataataatcagaatttttagttttacttttttcttttacaatatggattttgttgttatttggatagtggttcaataaatcttaagctcagataattaaacactattttgaatcttaacaagatactgaggctttttttgtatgggatgatatcaacctatgtacaatgaatttaataaacttaagtattgtcagattttttgcacattttagctcaataaaatcttaatgttcaagatttttttatctgcatttggaaatacaattttgtaaaatcaatgtcttacctttttgatacaatagatcatgttttgtttttaataaagcaagaagcccttttatctgttgtttttcagggaagggattaacatttaattctgtttgtttacatttgttatcattgttatccaatgctcattttatgttgctttataagtaggcttaggtataacagaataagtatctgtttatctaatctacatgtgactatcttagtctctctcggtcacttaatattatgctgaaatttaccactgtggggatgaatgatcgctattcaccaagtatatttgaacatgtaaatgcttaagaaataagcataatgcggatatagtttgggttaataggattctcatagttttttttcccctatgaaacataagtaatgattttagtgtatttcttatggaatacactcatttaaaaaggactttaagaaattgtggatgtgaataatacctttctctaataaaaatttaaattgtataatagttttataatatttacattaattgatattttaatatggatagacattgcatagattcaaataaattaaaatcaatgataaatgctaaatattttatctaaatagtttttcaagaaacagttatggaaatgtgtatattaaatggctctaatgtggagcttgtggtatttcaactcagtattcattattagttgtgtgtctggaaagattgtacttacttttcctctttacactacagtttgctcttatggggctctaaactgtttaactgaagaaccttcgtctgtattttgattgagcataatttagtattttatgatttccaagatgatgttcttatgtctatcaagtctatgtatcaaatttataacatcatttaagaaaaaggaatttccacagatacttcagttgcaattttttgtttcatgctactgaaaatacatttgtttctaggggttggaatattatagaagatgtaggatgaaagaaaacgatagaacaacgaaagaattctgtttatgaaattacaggaattgtgtccactatggtaaagcattgtcattttagtacattttctcttagtagtttggcattttatactttaaaacttgttttgctttaaaaattgtttataatgcttaccttctttctccagtgcctttagtcttgatttgatatgtttgtaccctcagttaccctttctattacatgtttttgatgttttcatagcctaggaaacatcgattcctttttaataattgtcaatctgattatttaaagaggtaacaattatctgttaatgctttggaaaaacaagtagggttgcctttggaggccaggcttcttagttcattcaaaaatattccttggatttatgccatgtattaagcatttttagcccccagtattacaactgtgaaccaaacggataaggccctaaccattttcagcattctctttggatggggtgggattggggacttaattaaaatagagatatagaaaaataggcatctaaataagataataagtgtggggttgaaatgaagcatctaacaatagttgaagttagaagtaatattttacagtattgtaacctctatttaagtttgggtattagttacagatagcataaaaaagccttaatttttcactttccttgctggcaaaggtacatttatttagactgtccatttaaagtaatgtttaacataaacattactgtgaaaaacattccattacatattcccaagcaaatgagctgcatcttctttactgtattttacaatttagtacaacagttttaggcctcaatcttaacatcactggtattttaaatttggcaatgaatatgaaattacttttgacttacagattgattatattattactttgaaaatgcattaatttcttagaaaagtttggagcctctatctttttttgagttaatacttaaattctcattacttatattaatagcctgtactaagtgaaaatattatttatgcaagtaaacaagtcactataggcttttaagacttttctttaattttagattttgtcatcaaagtttaaattttttacctactgtccacttaaatataatttaacagtttgtaaagtgaaatagttttaagtatgatgtatgatgcacctgcatataaatgaaaatggcgtgcacaaagacactttactatgggaactgtactggaagatttatgaaagcatgtgaaattgcacctaaaattgtgttattagtgactataagcagcaatgctaaatttattgtacttgatgaatgaatgtatttagtcacagttactttggtttaaatgtataaatgtctttagggtttttttttaaatgtgtttgtaatttgtactattgtgggggtatacttggactgcaggggttattgtcaatgtgtgatttgtgtttttattttatagaatcatctaatgtgatataccaatttttataagtgatatttacataattctaataactgtatatttgacaacctattaaaatgttttgcattggaa

SEQ ID NO: 142831 - DNA, 4733 bp, Homo sapiens
  Payload ID: 8222
  Gene Symbol: INPPL1
  Gene Name: inositol polyphosphate phosphatase-like 1
  Uniprot ID: O15357
  ENST ID: ENST00000298229
  CDS Start-End: 205-3981
tgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 142832 - DNA, 717 bp, Homo sapiens
  Payload ID: 8222
  Gene Symbol: INPPL1
  Gene Name: inositol polyphosphate phosphatase-like 1
  ENST ID: ENST00000320683
  CDS Start-End: 1-449
ggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcaggtgggggaggggctggccccgggggcggagctggggccctcaggatccccttgcccatctcacttcccagcctgttttactccacagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctg

SEQ ID NO: 142833 - DNA, 353 bp, Homo sapiens
  Payload ID: 8222
  Gene Symbol: INPPL1
  Gene Name: inositol polyphosphate phosphatase-like 1
  ENST ID: ENST00000535985
  CDS Start-End: 1-125
cgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgcccgggacagggtcttgcaagcagcctcctgggcagtcgtaagggttgcggcgtgatgtcttcaataaattaagttttatttgga

SEQ ID NO: 142834 - DNA, 741 bp, Homo sapiens
  Payload ID: 8222
  Gene Symbol: INPPL1
  Gene Name: inositol polyphosphate phosphatase-like 1
  ENST ID: ENST00000540329
  CDS Start-End: 361-741
ccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccgg

SEQ ID NO: 142835 - DNA, 275 bp, Homo sapiens
  Payload ID: 8222
  Gene Symbol: INPPL1
  Gene Name: inositol polyphosphate phosphatase-like 1
  ENST ID: ENST00000543234
  CDS Start-End: 223-275
ccggagcagcccgggagttgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggc

SEQ ID NO: 142836 - DNA, 375 bp, Homo sapiens
  Payload ID: 8222
  Gene Symbol: INPPL1
  Gene Name: inositol polyphosphate phosphatase-like 1
  ENST ID: ENST00000540973
  CDS Start-End: 309-375
atccccattttccagagcgggaagccgacgctcaaccccgcgccgcgacttgcccgaggtcacccagtgggccagcggctccgggaccgaggcgcggggcgggttgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtacc

SEQ ID NO: 142837 - DNA, 856 bp, Homo sapiens
  Payload ID: 8222
  Gene Symbol: INPPL1
  Gene Name: inositol polyphosphate phosphatase-like 1
  ENST ID: ENST00000541752
  CDS Start-End: 1-594
gtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccc

SEQ ID NO: 142838 - DNA, 4656 bp, Homo sapiens
  Payload ID: 8222
  Gene Symbol: INPPL1
  Gene Name: inositol polyphosphate phosphatase-like 1
  Uniprot ID: O15357
  ENST ID: ENST00000538751
  CDS Start-End: 854-3904
tttagacagctgtggaggccacaaaagagctccctgttgcttctcaggccctgccctgtggtgggtgtggagtctgtgtaggtctggtggggagacgggggtgttctggtcattcctgcccaataggcaacaccaggagggtggaagtggaccggccacatcattaaccctgtgcagcctgggcaggtggttttagggaaaccaagctgagggggttggggtgctgagcttgctggcaggaggaaggggtgctttgggtcttagaccccagcctgggggtgacagattctggccctgccttggcatcaggtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcagatggggaggatgagaagcccccgctgcccccgcgctctggctccaccagcatttctgcccccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 142839 - DNA, 550 bp, Homo sapiens
  Payload ID: 8222
  Gene Symbol: INPPL1
  Gene Name: inositol polyphosphate phosphatase-like 1
  ENST ID: ENST00000537656
  CDS Start-End: 450-550
tgagacccccatcccatccactgaacaggagaccctttctcctctgagaactatttccctaccaaaggtggggaggccttctaagaccccaccagggacccccaccccacctcagcccagaggcagataacctgatccatcccgccctggttgccacaggtactatctcctctagggatggggcagaggtgctgggacaggtcagcaggacctccactgacttcttaacccctccccaaagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtc

SEQ ID NO: 142840 - DNA, 4649 bp, Homo sapiens
  Payload ID: 8222
  Gene Symbol: INPPL1
  Gene Name: inositol polyphosphate phosphatase-like 1
  ENST ID: ENST00000541756
  CDS Start-End: 321-3761
tttagacagctgtggaggccacaaaagagctccctgttgcttctcaggccctgccctgtggtgggtgtggagtctgtgtaggtctggtggggagacgggggtgttctggtcattcctgcccaataggcaacaccaggagggtggaagtggaccggccacatcattaaccctgtgcagcctgggcaggtggttttagggaaaccaagctgagggggttggggtgctgagcttgctggcaggaggaaggggtgctttgggtcttagaccccagcctgggggtgacagattctggccctgccttggcatcaggtatcagaagcatgtgcacacgtatcgcattctgcctgatggagaagatttcttggctgtgcagacctcgcagggtgtgcctgtgcgccgcttccagaccctgggtgagctcatcggcctgtacgcccagcccaaccagggccttgtgtgcgccctgcttcttcctgagggtgagcgagagccggacccaccggatgaccgggatgcctcagatggggaggatgagaagcccccgctgcccccgcgctctggctccaccagcatttctgcccactgggcccagcagtcccctgccagctcctgagactcccacagctccagctgctgagagtgctcccaatgggctgagcaccgtctcgcacgactacctgaaaggcagctatgggctggacctggaagctgtgaggggtggagccagccacctgccccacctcacccgtaccctcgctacctcatgccggaggctgcacagtgaggtggacaaggtcctgtcaggcctggagatcctgtccaaggtgtttgaccagcagagctcgcccatggtgacccgccttttgcagcagcagaacctgccacagacaggggagcaggaactagagagcctggtgctgaagctgtcagtgctaaaggacttcctgtcaggcatccagaagaaggccctgaaggccctacaggacatgagctccacagcacccccagctccgcagccatccacacgtaaggccaagaccatccccgtgcaggcctttgaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcatccgccagctcattaagtcccagcgtgtccagaacaagctgggtgttgtgtttgagaaggagaaggaccggactcagcgcaaggacttcatctttgtcagtgcccggaagcgggaggccttctgccagctgttgcagctcatgaagaacaagcactccaagcaggacgagcccgacatgatctcagtcttcataggcacctggaacatgggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccgattgccatgcaatcactgtggaatatcaaggtggcagtgctggtcaagccagagcacgagaaccgtatcagccatgtcagtacgtccagtgtgaagactggcatcgccaacaccctggggaacaagggggctgtgggcgtctccttcatgtttaatggcacctcatttggctttgtgaattgtcacctcacctcgggaaatgagaagacggctcggaggaaccaaaactacttggacatcctgcggctgctctcgctgggcgaccggcagctcaatgcctttgacatctctctgcgtttcacacacctcttctggtttggggacctcaactaccgcctggacatggatatccaggagatcctgaactacatcagcaggaaagagtttgagcccctcctcagggtggaccagctcaacctggagcgggagaagcacaaggtcttccttcgattcagtgaggaggagatctccttcccacccacctaccgctatgagcggggttcccgggacacatatgcctggcacaagcagaagccaactggggtccggaccaatgtgccctcatggtgtgaccggattctgtggaaatcctaccctgaaactcacatcatctgcaattcttatggttgcactgatgacatcgtcaccagcgaccattcccccgtgtttgggacatttgaggttggagttacctcccagttcatctccaagaaagggctctcaaagacttcagaccaggcctacattgagtttgagagcatcgaggccattgtgaagacagccagccgcaccaagttcttcatcgagttctactctacctgcctggaggaatacaagaagagctttgagaatgatgcccagagcagtgacaacatcaacttcctcaaagtgcagtggtcttcacgccagctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagaggcctcctgcccgctctccaggttatttgaagaaccagagaaaccgccaccaacggggaggcccccagccccaccccgagcagctccccgggaggagcccttgacccccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccggggactgccctcggactatggccggcccctcagcttccctccaccccgcatccgggagagcatccaggaagacctggcagaggaggctccgtgcctgcagggcgggcgggccagcgggctgggcgaggcaggcatgagtgcctggctgcgggccatcggcttggagcgctatgaggagggcctggtgcataatggctgggacgacctggagtttctcagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttgga

SEQ ID NO: 142841 - DNA, 1919 bp, Homo sapiens
  Payload ID: 8223
  Gene Symbol: INPP1
  Gene Name: inositol polyphosphate-1-phosphatase
  Uniprot ID: P49441
  ENST ID: ENST00000322522
  CDS Start-End: 457-1656
ctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccagga

SEQ ID NO: 142842 - DNA, 2162 bp, Homo sapiens
  Payload ID: 8223
  Gene Symbol: INPP1
  Gene Name: inositol polyphosphate-1-phosphatase
  Uniprot ID: P49441
  ENST ID: ENST00000392329
  CDS Start-End: 701-1900
gaatggaggaggaagatttaaaagtgaattcgtgggcggcgacaaggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgagggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccagg

SEQ ID NO: 142843 - DNA, 631 bp, Homo sapiens
  Payload ID: 8223
  Gene Symbol: INPP1
  Gene Name: inositol polyphosphate-1-phosphatase
  ENST ID: ENST00000409027
  CDS Start-End: 166-631
agattactgcagcatttgtgctgaaactcaccagggttaaattgatgagctttctgcgtgaaagaagggagtggtggtgatttccggagcttgtagccaggctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatag

SEQ ID NO: 142844 - DNA, 613 bp, Homo sapiens
  Payload ID: 8223
  Gene Symbol: INPP1
  Gene Name: inositol polyphosphate-1-phosphatase
  ENST ID: ENST00000413239
  CDS Start-End: 349-613
gcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacaggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggg

SEQ ID NO: 142845 - DNA, 626 bp, Homo sapiens
  Payload ID: 8223
  Gene Symbol: INPP1
  Gene Name: inositol polyphosphate-1-phosphatase
  ENST ID: ENST00000458647
  CDS Start-End: 198-626
tgtcctcatccccggcttaggtaacacgttttcctccttacgacacccaccacagggtccccgcgccgctgcccctcctccttggatctggggcccgggctggtgagcggcgcgcgccgtcgcctctccgcggctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgtt

SEQ ID NO: 142846 - DNA, 840 bp, Homo sapiens
  Payload ID: 8223
  Gene Symbol: INPP1
  Gene Name: inositol polyphosphate-1-phosphatase
  ENST ID: ENST00000423767
  CDS Start-End: 205-840
gtgagtcgatggcgccgggagggttcctcgcctctgcgcgccggcctgcgaggtccctgccccggcagcgaggccgcccccggccgggcccggccaggcatgcccggcatcgccgctgcagccagcgcggaggggagctcctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacacc

SEQ ID NO: 142847 - DNA, 797 bp, Homo sapiens
  Payload ID: 8223
  Gene Symbol: INPP1
  Gene Name: inositol polyphosphate-1-phosphatase
  ENST ID: ENST00000444194
  CDS Start-End: 226-797
gggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctctccgcgggtagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacat

SEQ ID NO: 142848 - DNA, 812 bp, Homo sapiens
  Payload ID: 8223
  Gene Symbol: INPP1
  Gene Name: inositol polyphosphate-1-phosphatase
  ENST ID: ENST00000431594
  CDS Start-End: 172-812
cgtttctcgagggaaaggctgctgcctcctgctctgtcctcatccccggcttagggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaggaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcag

SEQ ID NO: 142849 - DNA, 425 bp, Homo sapiens
  Payload ID: 8223
  Gene Symbol: INPP1
  Gene Name: inositol polyphosphate-1-phosphatase
  ENST ID: ENST00000451089
  CDS Start-End: 335-425
gggcccggccaggcatgcccggcatcgccgctgcagccagcgcggaggggagctcaaattgcttaaaagataattatgttatataaagtgatcaatgaaaacaaacgtcatcttcattttttaaagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagc

SEQ ID NO: 142850 - DNA, 541 bp, Homo sapiens
  Payload ID: 8223
  Gene Symbol: INPP1
  Gene Name: inositol polyphosphate-1-phosphatase
  ENST ID: ENST00000458193
  CDS Start-End: 338-541
gctgaaactcaccagggttaaattgatgagctttctgcgtgaaagaagggagtggtggtgatttccggagcttgtagccagggtgattagctcgcctgagtgttattagggtgttataaggagtgtttcttggttattcaacagtgtagttagtatcgtttcttttaagaaaaaaaattgattttaacacttgaataaaagaaacactgctgatattgtttatcttgaaagctttcaaatcggactccttgagatcttcacgctactgttaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaag

SEQ ID NO: 142851 - DNA, 552 bp, Homo sapiens
  Payload ID: 8223
  Gene Symbol: INPP1
  Gene Name: inositol polyphosphate-1-phosphatase
  ENST ID: ENST00000430311
  CDS Start-End: 524-552
agccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctg

SEQ ID NO: 142852 - DNA, 6752 bp, Homo sapiens
  Payload ID: 8224
  Gene Symbol: INPP4A
  Gene Name: inositol polyphosphate-4-phosphatase type I A
  Uniprot ID: Q96PE3
  ENST ID: ENST00000074304
  CDS Start-End: 394-3327
gtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgtttaactcttggagtttttagtattaccaaactcctagaaatttaagctaccaccaaaaataacatgtgccttttccctttattctcattgatggtagcagtgcacctcgtttcagtgtcctgattccttgattactgtgaacactgaacatcttttatacctttatgatatttctatgtttgtgacttcattggaatgttgatctatttcatatagattgtttttaatatacaatgtattagcccctgtca

SEQ ID NO: 142853 - DNA, 1565 bp, Homo sapiens
  Payload ID: 8224
  Gene Symbol: INPP4A
  Gene Name: inositol polyphosphate-4-phosphatase type I A
  ENST ID: ENST00000409463
  CDS Start-End: 394-1314
gtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagc

SEQ ID NO: 142854 - DNA, 9996 bp, Homo sapiens
  Payload ID: 8224
  Gene Symbol: INPP4A
  Gene Name: inositol polyphosphate-4-phosphatase type I A
  Uniprot ID: Q96PE3
  ENST ID: ENST00000409016
  CDS Start-End: 398-3214
cggcgtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgtttaactcttggagtttttagtattaccaaactcctagaaatttaagctaccaccaaaaataacatgtgccttttccctttattctcattgatggtagcagtgcacctcgtttcagtgtcctgattccttgattactgtgaacactgaacatcttttatacctttatgatatttctatgtttgtgacttcattggaatgttgatctatttcatatagattgtttttaatatacaatgtattagcccctgtcatatgttgcacactttttaacctatttgtcagctgtcttttggtctgtggtaggagttatacagtattttaaatggtttatgtagtcacatatacctgtctttcattttgatgcttgttctgaaatggagtcctggcttcaccatggaaggtgggacatatgggacagccatgtccttgtgggcatggtggtgtggctgcgtgcccacgacgaggggctggactaaagtgctcactggcaccttgcttggtgcatgggccatgctcagtttaatattattaacagtttctaccttcactctcatgtctcaggattattttttcagcatttacctgttcttatttctaggatgtttatggtttcagtcctacatttagatcaatccatctggaatcatcttggtgtaagtcctgtgttgtgcttacagtatgtaaagtcagagggaatccctcaaggtcaggcctaattttgcttctctttaaagttaagccaagaagaagacatgtcaggacgcccagacatcagctaccgtgagcttcttcctgccctccctccgcatgccattctggtgctgcgcttcagtttcctgttgagtctctgcttagtagatgacttggcacaatctggctgcccagatctaggggagttgtcccagggaggctttgcgctggaggaaggtaagaggagctggaggttggagcttcccgatttgtgatttttccaagaacagaaatgattagccatgtggggaggttacttcattgtacattgttctactgcataacctccctctattctttaccagcatcacacagcaggttggcaccatttttgaatagaggtttctcacagtatcctcagcagcattgagtgttcctaatgttgtagtaatgagcagtagatgtctctcagtgggcagtgtgacctctttggtcactctaaagggctgccagcatttctcttaagctggggggagaagagctgttctgtgtataggggtattgggaacacatggacagaaggaactggcctcacatgccatcgtgttcctgggatggctcttccaagaccagcagttcctcctggcaggcaggccctcacagaactctgcatttggagatggacaaactctcttcttcttatcactttctccccaaaatgtcctcttctaccagcccctcttaagagccgattttctgtaagttatagtgagggcactgctctgctgtgcacagaaggaaccccagcccagaagcacacgctccctgtggaacctgcaggggtggcagtgatgacagaaccaagggggtcaaggaagattggagaggagtgggcagcaggaaacagctcaggctgcctgacctggcccccggctgcccatgagggcctccagagaggggcagagctggcttatcgggatccatgatggtttttacacttttaaaagtgccctcttctcagagaccctggttatttccaaaagtaggaagtaatcaaatttacagtggataaaatccagtatttgaaatcaggaagacagaaaaaaaagcaaaatagcatccttttctgagaggtatatgctgaccaaaaagatctttcattcctgtgaacaccaagcagcgcggcctctggcagagagagcgctgggttgtacagatggaaacttgtgtttagcaggctgtctgctcccaatagtggccctggctgcaactgacctcctgatgccctgctgacgctaactgtgggtaccaaccagcaccgtggacatcggccccaggatcagtctacgatttgtctggtggccaaatgatgacttttgagtgggaaaagctggtgggggctacaccgtgctctgcagtgtagtgggatcctgtgagctggcctgcacaggcactccctcccctgccaggggccccagggaggcttctccagcctgaggctgcaccctccatacgattccaccccccatcctgtgccaacagtaggcaaacggagagtagcttggtcttgtttttattagctgttgccctccaggctacgacagggttcccagggtgtagcctgaaaacacccatactctagattccctccactggaaccctgtctttgccatgatttcttcctgcatcaggcccctgtgggccttgcaggccagtccaggcaggtctttcacactgttgtcccacataacagaaaaagctgagcagacagggtaggaaacacacttgcatctccatggctccaaagaggatgcctgtgttagatggatgtagacagacacagcacttcactgcttcctcctcctcgccacccagccctccctcggtgtctgtggcctgactctctcctggtggtcctacgtctctgaccatccctcctcactctcaaattttatgttgcccaccacctgccactaatggcgtggtgttctcctgggttccctttctcacttaagatgatcttcctgaaaaatcttacacattcctgttgaacaaatggtcacttatatggtagtgactcctaaatttctaggtccatcccagactctcccccaaggtccagattacctatacatctaagcaccatgcctgtcttgcaggcatctcaaatacagcatgctcatgcctctcctcctccaagctggctgagtctccctctaatagacgaccttgggatcattttctcctccacatcccatcaatcagccactgaacctgtatctcttgagaaccatcccataatttccatccatgcaccccaaggcctggtctgtatcagtcccctcggatctggacctctcctgagcatcctcacccctcctgcaaggctagtctcaggtctgccttcctctatggtgatttctccccacaaatgaagttggccctttcaaaaaaacttcctctccttcattgttgactatgaagattctttcatgcatgtcctgtccactgtcagtcccctctgtattcacaagagcaagtgtaatgcccgctgtgaaggagctaaagtttgttgaataaacacatgaacaaatggtggttttgtggtgttcaactgaaatatttcctatttcagcactggaccacgctgtttttctcactacataatcggttacgctaaatgcatcacgagccaaattcaaaaggtcaaaggagaaggcaaatggcagagtgtggtaaaggggcgagtgagagggtctctgaaaaaagtcaggctaaaattacagggggttcaggcaatgttatcttgatctggatggccagttacatgacagattactttgttcttaacatacgaacatcctattcactttttggtatactggttgtttaacagtaaaaattaaatgtttaaaacc

SEQ ID NO: 142855 - DNA, 3365 bp, Homo sapiens
  Payload ID: 8224
  Gene Symbol: INPP4A
  Gene Name: inositol polyphosphate-4-phosphatase type I A
  Uniprot ID: Q96PE3
  ENST ID: ENST00000409851
  CDS Start-End: 394-3312
gtctagagcggcggcggctggctagggctgcggcgcgcgtggagggttcgctgctggtttgccgccgggtcgggctccgtgggccggggcaggaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacatacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctag

SEQ ID NO: 142856 - DNA, 3231 bp, Homo sapiens
  Payload ID: 8224
  Gene Symbol: INPP4A
  Gene Name: inositol polyphosphate-4-phosphatase type I A
  Uniprot ID: Q96PE3
  ENST ID: ENST00000409540
  CDS Start-End: 302-3166
gaggaccagcacctgaggccgggcccgcagcccgcgacttcacagccaggcggcggcgctgctgctgctgcggggctctggcgcgcagcccggcgggacagcggggcggctggcgccgggggccggggagcgccagatgatggatttggacatgcttctatgaagaaatgccacatggtccgagagcaaacatgtccaggctactgccactttagtggactagggctcggtgccagcacttcccgggtaatcaggcgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagcattggaacacgggaggtagtcacccagaagaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaacatgtccagccaccg

SEQ ID NO: 142857 - DNA, 2934 bp, Homo sapiens
  Payload ID: 8224
  Gene Symbol: INPP4A
  Gene Name: inositol polyphosphate-4-phosphatase type I A
  Uniprot ID: Q96PE3
  ENST ID: ENST00000523221
  CDS Start-End: 1-2934
atgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtga

SEQ ID NO: 142858 - DNA, 3741 bp, Homo sapiens
  Payload ID: 8225
  Gene Symbol: INPP4B
  Gene Name: inositol polyphosphate-4-phosphatase type II B
  Uniprot ID: O15327
  ENST ID: ENST00000262992
  CDS Start-End: 218-2992
gacttctttccattttgttttttgcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaatt

SEQ ID NO: 142859 - DNA, 526 bp, Homo sapiens
  Payload ID: 8225
  Gene Symbol: INPP4B
  Gene Name: inositol polyphosphate-4-phosphatase type II B
  ENST ID: ENST00000506000
  CDS Start-End: 249-392
agtcgagatggacctgaggaagaccacatgagggctgatggggaagaggcatttgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttggaaattaacttcatattcactctgtaagccaccacttgtagaaggtctgttttttttctatggaagcggatgattgtaaaaagtgtcatgtggatatgcaattcagtatacatctgtaccagcatgcaaggatctcgtggct

SEQ ID NO: 142860 - DNA, 2155 bp, Homo sapiens
  Payload ID: 8225
  Gene Symbol: INPP4B
  Gene Name: inositol polyphosphate-4-phosphatase type II B
  ENST ID: ENST00000514525
  CDS Start-End: 98-2155
atatgcagagaaaattatagttagtgaaacaactctgggtgctgtattttacctcttgttattttctagcctgttggtctcttttcttttagggaaaatgatacattttcaccctttaatcctaccccatgagcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatcc

SEQ ID NO: 142861 - DNA, 583 bp, Homo sapiens
  Payload ID: 8225
  Gene Symbol: INPP4B
  Gene Name: inositol polyphosphate-4-phosphatase type II B
  ENST ID: ENST00000503927
  CDS Start-End: 467-583
gcgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagggggcgctgttttggggaaatggcagaactccctcagaggctgatctaagggttcccggcagaaggggccatcttcagaggctctggttgcatgactgtttggagtttgatggcctgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccg

SEQ ID NO: 142862 - DNA, 4334 bp, Homo sapiens
  Payload ID: 8225
  Gene Symbol: INPP4B
  Gene Name: inositol polyphosphate-4-phosphatase type II B
  ENST ID: ENST00000509777
  CDS Start-End: 346-3162
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagcagacaaacccagggagcactgaatgaatccgatgatcctgaaacaggctgtctaactgataacaagccaacttctcgacacttctatcctgtcgccttgctgcttgtcagctcacacctgctagttgtgtggcttattttaagtctggcgttactcttagccaaataccaataagttttatgttgtattcctttttcttttctacaaatgacaatgaactttaaattatggggacaatgctgtaatatttttacattttcaaattcacagaatttaaaaaatgttaaattgtgtttagtttgtttttcctaaaatctaaaaaacaaaaagtactatgcattaggtggattattttgctcttttgttcatggaaaggtgtttcccactgttaactagctcaagaagaatttttaaattactgtctttggaataagacaaagaacagaatcctgaaagcttgaagttctgaacctcctgtcctcatcccactaaatttattaaagaaattaagactgaaatttgcacaaacactgaaaccctgagacaagttctagagatgtgggaggttgcagactttatttccactgtgctaatatcatagatgccatctgctgatagaaattttttttaacctgttttacttctttgctgcaattaactcttttctgtcaagtaactttatggagagaatggctatttatgttttgtaattaaattacctgtttgtatctcttgtttgggttgatttggctttcagaggacttttctattctttttaacaaggtcttgtttgtgtcttgatgtaccattcccagcacttgtgacttttgtactgtccgtggacaagcactcttcctttataaagctgagacttggcccaggctgttcagaaagccattttctctcttccttgcacagctaaaataataaaatagagatgaaatttttctttaaaaatctatagggccagacttaataaattaaatgccttatttctagaacctgcatccttagggctacatatagattttaatgtgttttaaagagactgagaaattaatttgtggaaatgttataaaaaggcagatatatttatgaaactaaagtggagctgtattgtggagcaaattatatttaaagagtttattaaattttaaatgttaagagtaaagagacttaagtcatctctttcagagggcaataatggtattgggcctggcctaggatttaattttgtaagatgtatcatcacttgtggaaaaaaaaaatgtagagttgaatctttgttatttttacttggatggttgctgcaactctgcattaaacaaataaagcatatttattta

SEQ ID NO: 142863 - DNA, 2953 bp, Homo sapiens
  Payload ID: 8225
  Gene Symbol: INPP4B
  Gene Name: inositol polyphosphate-4-phosphatase type II B
  ENST ID: ENST00000512630
  CDS Start-End: 263-1513
aaaggataaattaaagtcgagatggacctgaggaagaccacatgagggctgatggggaagaggcatttgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattattctactactcacgaaagattggctggcctcccagtataccagtctagtaagtctgcacataatggcatgaaatcaaaagacataaattcaattgaaagctcacttagatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacac

SEQ ID NO: 142864 - DNA, 3165 bp, Homo sapiens
  Payload ID: 8225
  Gene Symbol: INPP4B
  Gene Name: inositol polyphosphate-4-phosphatase type II B
  Uniprot ID: O15327
  ENST ID: ENST00000508116
  CDS Start-End: 354-3128
cccaagaggggtcttactcatccttttccattttggagaggttctgctgactctacattaagcccagacagggtggtgtcctgctttgctcctttctgctctctgcgttcctctgctgccttgatggattctgatgtggttgctcagatgatcagcctgcaggagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaataca

SEQ ID NO: 142865 - DNA, 673 bp, Homo sapiens
  Payload ID: 8225
  Gene Symbol: INPP4B
  Gene Name: inositol polyphosphate-4-phosphatase type II B
  Uniprot ID: O15327
  ENST ID: ENST00000506217
  CDS Start-End: 1-396
atggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggtaacttaatgagacacaacagttttcttgtgaaatagctggacatgcagagaggtcacatgaataataagctcacacctgtgttcccgccacccggatattattcaaagcacaaaacatcataaataaagtcaaggtcctctata

SEQ ID NO: 142866 - DNA, 719 bp, Homo sapiens
  Payload ID: 8225
  Gene Symbol: INPP4B
  Gene Name: inositol polyphosphate-4-phosphatase type II B
  ENST ID: ENST00000506297
  CDS Start-End: 1-102
gagtatcccatctatgaggagaccaaaataaaactaacagtctatgatgtcaaggataagtctcatgacaccttcaggatcaacagattaacttcactgtgaattttttgacccctgaggcaagtgttcaaaccagtattgacttggcttcttccaaccttcattttatgtgtcagctgtgatgcaatacttcaagtgcttcataaagataagggctgcacttttccctcagagcactggccaaataataatcaggttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcag

SEQ ID NO: 142867 - DNA, 8831 bp, Homo sapiens
  Payload ID: 8225
  Gene Symbol: INPP4B
  Gene Name: inositol polyphosphate-4-phosphatase type II B
  Uniprot ID: O15327
  ENST ID: ENST00000513000
  CDS Start-End: 435-3209
cacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaaggctttacaggaggcatagtactggaaatctgctcctgatgaggtctcagaaagcttccactcgtggtggaaggcaaaggaggagcaggcacatcacatgagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaattacaaataaaataaaaatgaacaacattttgatacccaaaatgaaaattcccatcagcctgaactttatgttgtgaagttcatgaatgtcagtgaggtatctctgagatgtttcttagcagtcatcctggtgtaagcatgcagttatggcataggtttgtgtgtgttaataagcctttaaaacatatgcaaccacaacaaatgataaagtaaaacaattattttctgttgccctgaatatcaaacttgcccttgcccttactcagcaaaataacatttataagttttccaaaatcccaaagtagaagtttccttaaaaaaatcatcttgtataataccagtattcaaacatgggtaaggttaatcacccccaatcactcaggagatagttgcagaatttgaattacaatctcttcttactttcctagcctgtggcttgtcacttctccaaattgccatgctaaatatgcatgaaaattgagggagaatgctagttaaaaagaaattaggatttatcactggaattgaaactaagagtacaaaagtctgaacgaatgaaacttttctccaaattttacaaattcttgttcctttctcattagaagagcatgctatccaaagcataaatctcccttgaaaataacagaggcttcttaagccctctcttagctatgatcaatggatgatattatgcttcccatagctaatgtgatagctccttgcctaggattcctgttgaaataaggattctagccccatgttaagtttttcaaattactacaaattttagataagcatttggagctttttatactagaattatcaattttttattttagctaattacctgtgggcattatacttgaggcaggtaccaaactacttacagcctttttaatgaaaatgtgctgtgtactttgaatccattcatagacaaaattaccttgatgttctcttaactcattctttattttagtgattaaatacaacctttgagttgttcaatatcatttgaaaatggtaggatttgtggttattttcattaccctattagatttaagataggctgggatgacagaggcctccttgaatagctatgaagcctcattcagcatatcaaatggtagtctgagttctaagaaaccttaagtaatttatcattctgtaaatactcttataagcaataatttttatttgtatttttgaaaacaaactacttaaatatggaaaaatattaactggaaagccagcagtagggttttctatttttaaaagacatttcaaggatttcctgtaatcccagcactttgggagccaaggtggatagatcacctgaggtcaggaattggagatcagcctggccaacatggtgaaaccccatctctactaaagatacaaaaattagctggatgtggtggcacacacgtgtaatcccagctacttgggaggctgaggcaagagaatcgcttgaaccccggaggcggaggttgcagtgagctgagatcatgccattgcactccagcctgggtgaaaagagcgaaactccatctttaaataagtaaataaatgaataatatagaagtctcaaattatagtgcttactgtaatacaaatgcttatgaattttcattcattaccatagtcatctgcatttccttatagaaagcctgtactggtgcaaacttctaaaagtggatttcatcaagaaaatgtgtttcatagagacaacaatattgcttttttcctgagaggcagttcattcttaaacaaccacttcactatttcttaagttattaaggctaaatcaaagagcaaatgttaaagtgtttaaatctctcttgaacaaacacagccacagtcatgctattctatctatattttcacttaaaagatacaccagcagacctattttaggaggtcatattgagccaaaaaatgaactgagcaaatgacatttccaaactctttttttgctcaaaaataatatgttcccctttgatattaaatgcagatatcaattctggattagctatttactgagccctaggaaaaacatatttaaagacaaggaaaccattcatttacatctcatatcattgctttttgcttttaaatatcgccttgaggtttgtctacactctgccaaaacaatccctgaacataagtttggtcagcctcataattcagtgagtcgagcaaccatttgttccaagtgataaattgtactaaatgacaaactgcccaatcagggcagagctccatggacccagcctccagcccttattttataagactaacccctcttctgaaaaactctgaaggcttaaaagctagcatttggatggaggatacttcctttttatccttcagctatgtatggcactttacataaaataagaggtaaaaaaggagagaaactgatgtgtataaagtaatgcctttcttcccaagcaaatcaaacctctccctatgtaaaagttgatagtgtaccaagagacacaataccactggtgggctggaactagctcgttctgatgcataaaagttgataattaaagtaccagaaattttgtaagctagttgttaaacattaccattattaaatatgaaattataaaacacagtggaatacattaaaaaccaatgtaataatcaaaacataccacttcccaattattttactaccttatactatttattagtactcttgagtctatttaggtctattacatctttacagtgaaaacaggatacaatattgtgctactgtgggtctcttcctgactgcagattcagtaacatggtgttcgtagcttgaaactgtccacagtgggagtatttaacaccatagaaactggctggcaaatgctacaaactagcaattttaattcctggaaaggcaattgttgagcatttaccagcacacaatgaatgccatattcttttttttttattaggaaataaattattggaggcagtataaaattatttaaaaagtatcaaatgcaatcccttatcttcagatggctataattttggttatataaatgttttggtttttaccttctttaaagactcctattaggttaaaagtcatatttgatgactatattttattcataattaaattattaaatcaccttttctcctgataatgctttgccagagaattcttagcaattcaactgtagtctaagcaataactcagggctaaattcagggaactgttagcccaatcagatatcactaaaaatgtacttcaccatctattttggagtttataattttggcatttgctaaaagtaggaaaaacagtaacatattactgtgcccagattctaataaatatagctcaattgaaaccaaaactgttacattaaacaaattacactctggcactatgctaaatcaccacagatgttttaggtgtttgatttccaagcaggatggtatatcatttgtttggttcaatatatgaggcaccatttgtagtcttttaggaaataaattagcttttatcacagatttaggaaacttgtctaaaaaaactgtgatcatcagttacagagggaaggaaacatattgaacacaaggcatcatagtagctggaggccttaaaaattatgcacgaccaaaaagaatgatttggtgagagatgtgtagctgattgacaattttagtgtgaattcatattcatttaacccagcagcaatctacataagctatgctttttcccacctgtatttatgtttcttagcttataaagtcccaatatattatatcttttgttgctttggcagttttaatttagagctctgcgttcacagagatgccacctatagcaaaaactatctttaagaattggaaaataaaatgaatgttttagataaaatattgcaagccattatgtgtagagttaatgtatggaaatttgcatttgtttttctgaatcatggtgtacattaatcactcattgaattctatttctaagcaaataagagaatcaaacatttctaaaaggaacatatgtcttgctattaataacaaggagacaggaaaaatagtaaggtaatataagcaaaaaaaaaaatgtaatgaatttagctatcctaaattggaatttttacagattgcatgcatacttagaattttaaatttttaaaagatttacaattgagtatggtacccacagagagtgagtaccaagggaaggaagacctaatacaagtgatgttgcctgataaatcacatcttgccaaaaaaaatatattttagtaaatacagttctttaggaagaaaaatgttgccctttcacactcacagtgtaaatacattcataatattccttcaatcatctaaattaccgccaggtcatgaaaggacgcgatcaatgatgacctattgcactcacaggtaacattgactcaaattttggcaatattgctatattatctagataattcttgtgatgtttttatgtcactatcaacattaaaaatattttgttaaacaactatgaaactttcaaaagtttgcatataactgtatgggcactctcatttcactgcatacatacaatactttgtatacacatacttctcgtgtggatattttataattttatttaatctaacatttaacttttaggtttttgtggtactcatctgaaaggttggcatttgttttctttttatgttatatatgtattttagatgaatcaataatgtgtattcctagaaattttttctaggcataaatagatcattttatgttggcatttaagagatatcatttttgttttattgttctgtgtaaaccatattcattgtacactgtgtgtatatttttgtttaaataaatgatttttatttttta

SEQ ID NO: 142868 - DNA, 570 bp, Homo sapiens
  Payload ID: 8225
  Gene Symbol: INPP4B
  Gene Name: inositol polyphosphate-4-phosphatase type II B
  ENST ID: ENST00000507462
  CDS Start-End: 1-196
aatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaag

SEQ ID NO: 142869 - DNA, 2265 bp, Homo sapiens
  Payload ID: 8225
  Gene Symbol: INPP4B
  Gene Name: inositol polyphosphate-4-phosphatase type II B
  ENST ID: ENST00000511838
  CDS Start-End: 201-2265
atatctggaatacaaagttgttgctgccagtgatttgaggaattctaataagaggaacaacagcattgcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatcc

SEQ ID NO: 142870 - DNA, 1506 bp, Homo sapiens
  Payload ID: 8225
  Gene Symbol: INPP4B
  Gene Name: inositol polyphosphate-4-phosphatase type II B
  ENST ID: ENST00000507861
  CDS Start-End: 374-535
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgatttgaatcaagaattaagagattagcagctgcaagaatttattcataataatgttctaccagtataaaaaacttcaatttctttttttatatatatttttaaaatatactaagaaacaacaacagataattttatcttgtcaaatggcaagaaatgcttgatgagcgaacacaagtttactaaaaaaatattatttcaagtcatcatggaactgtattgttgatcctagaagacacagtccccaaactgttaggttccttagcactttaagatcttcaactacaccatttcttgaagaattttttaaaaactactctttcaagggtattacagataaacccgtggatgttttactgtccatttttgtcatttttttctttgagattttttaattccacaaatcctccgacgtcacctattattgtatgagtaacttctattcatttcccaatgaaagaataatagcttcttaaatatttttatcatgtttaagggtgtgcatatttatttaatcagaagtaaaacaagaacaaattctaggaaaaagaaattcagtaaggaagagggctttttcgtctaattttaactaaatctttgatatttgattctctactcttaaccaaagtattcaaattatttaggaatttcaatgaccttgctttctaaattaggaaaacagccacaccaatcaatttgctaggtgccatattgctttgtataagttattttccatcaaggatttgtgtctgctttgtgtgctgctatataataattatgtcttgctgaagttcttctgcttattgaattcctctactgaagttccttacttattcaaataagtaaggtaggaggtacttagtcaattgagcagctaattggctaaaagtgtcttgagcacaagataagcatgtactgaaaaactgagtatctcttgtccattgttaactgtatttctaatggttgattgcatttaaattaaataattcacccctacaa

SEQ ID NO: 142871 - DNA, 563 bp, Homo sapiens
  Payload ID: 8225
  Gene Symbol: INPP4B
  Gene Name: inositol polyphosphate-4-phosphatase type II B
  ENST ID: ENST00000506788
  CDS Start-End: 312-563
aaagcgcagatggggagagtcatttgccccacaccctacacagcccggaataaccaggaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtg

SEQ ID NO: 142872 - DNA, 2855 bp, Homo sapiens
  Payload ID: 8225
  Gene Symbol: INPP4B
  Gene Name: inositol polyphosphate-4-phosphatase type II B
  ENST ID: ENST00000510812
  CDS Start-End: 404-2855
ggatgtttcctgccctcgaacatcagaatccatgtttttcagcttttgggctcttggacttacaccagtggtttgccagggccccccagccttcgaccacagattgaaggctacactgttggcctccctacttttgaggttttggaacttggactggcttccttgctcctcagtttgcagacagcctattgtggaacttcaccttgtgatcgtagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaa

SEQ ID NO: 142873 - DNA, 354 bp, Homo sapiens
  Payload ID: 8225
  Gene Symbol: INPP4B
  Gene Name: inositol polyphosphate-4-phosphatase type II B
  ENST ID: ENST00000630044
  CDS Start-End: 193-354
agagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgatttgaatcaagaattaagagattag

SEQ ID NO: 142874 - DNA, 832 bp, Homo sapiens
  Payload ID: 8226
  Gene Symbol: INPP5A
  Gene Name: inositol polyphosphate-5-phosphatase A
  ENST ID: ENST00000342652
  CDS Start-End: 1-832
gcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgg

SEQ ID NO: 142875 - DNA, 1432 bp, Homo sapiens
  Payload ID: 8226
  Gene Symbol: INPP5A
  Gene Name: inositol polyphosphate-5-phosphatase A
  ENST ID: ENST00000368593
  CDS Start-End: 249-1412
gcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgggtgagtgtgtgctgccccagccctgggcacagagggatgtggagcgctgggtctggtctggcccagccctggtgacagggccccaggggtggggg

SEQ ID NO: 142876 - DNA, 2967 bp, Homo sapiens
  Payload ID: 8226
  Gene Symbol: INPP5A
  Gene Name: inositol polyphosphate-5-phosphatase A
  Uniprot ID: Q14642
  ENST ID: ENST00000368594
  CDS Start-End: 278-1516
ggaactttcccagcggatctaatggctgcgcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaata

SEQ ID NO: 142877 - DNA, 610 bp, Homo sapiens
  Payload ID: 8226
  Gene Symbol: INPP5A
  Gene Name: inositol polyphosphate-5-phosphatase A
  ENST ID: ENST00000445580
  CDS Start-End: 1-315
ctggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagg

SEQ ID NO: 142878 - DNA, 416 bp, Homo sapiens
  Payload ID: 8226
  Gene Symbol: INPP5A
  Gene Name: inositol polyphosphate-5-phosphatase A
  ENST ID: ENST00000423490
  CDS Start-End: 1-416
gtcacggccaacgtgggctcgctcttcgacgacccagaaaacctgcagaagaactggcttcgggaattttaccaggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacag

SEQ ID NO: 142879 - DNA, 3934 bp, Homo sapiens
  Payload ID: 8227
  Gene Symbol: INPP5B
  Gene Name: inositol polyphosphate-5-phosphatase B
  ENST ID: ENST00000373021
  CDS Start-End: 27-986
ggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggttcggcgggcggcgggaagctgggctggggagctgggccgggggcggcggtgcgcccggccctcgggtgggcagggtcggcggtttggccagtggacgctcggggcgaagaccaaagtcctggtggccctctggaggctgggacactggggcagaagttctgtgatgttcttcttaggcgtgcgtgacgagggtaggcgggtgggaatggggtacttgggaatccggaggctggggttttagtaaagctccgttccgaactcgctgtgtgacctcgggccactcgctgcccctctctgggcctgttgctccatctgagcttgctcttcaatcctgatcttccgagtttgtcgcgtggggcgggtgggggagtggtgccctgcctacgatagagtcttcctttgggtgaggtatggtatgtgttggggctctgtcagttctcagcccctgtgatgatagcgcagtgtacagggctggagtcttggggagccctgtctactctgggactagaggccaggatgaagttacaggttataaaaggactaggttttttcccacccagcagttggtggataatggggagcacagaaggccagttgctgagcaggagcttgtcgtttggagatgggaggctcagggctgaaatttgggtgagtccgtgctctgggaggacctgcagacctgtctttttttgtccagctccagggttttctgcaagggcccctggtgcttttttcccctgggtgtgtccgtgaggctccatttatgtgtgagctttggcatgacccctagtacctatttgtgacagtcatttgccagcaatgaagagcctgtcaagtagctgtgtaaagtgtgggccagccctccacttgctcttacaaggcttggaaactatgaggggcagggaggagtggcatgttgcacaagagtttgtaaactgagaggaaacgaggtgagcagaggacttcctcggtgcttgtttctccttcattgcagccatcacaaggtgcgatcgaagcgcctgatggtgctgatagtttgcatcttccttgggcttatctcagagttcactatcactagagtttccatgacattctgggctatggtgctgggacgggtgagagtttaagagcacctcatctccttgccccttcacaagagactgccagaatccagacaattggcggaggacaaggccaatggcagcagaaagaggtgggtgctgtgttctcagccagtacaccagagccaggccatgcaggcacttcattcccttagtcttctatgacaagtcaggccagctagctctgaagccagttagctgccccgactgagaaatgtgcagggatctcaatctttcatttcctttcaaaaaacagagactagccatatgctggtgaggaattattgttacggtttcggttttatttttattttaaaataatttgaaagctgaacatggtggcgcgtacctgtagtcccagccacttgagaggctgaggtggaaggcttgagcccaggagtttgagggtgatgtgcactatgattgatcctgtgaattagttgctgcactccagcctaggcaacatagtgagactgtctctaaaataaataaataaatagttttaaaaattttgtcagccaggcgtggtgactcatgcctgtaatcccagcactgtgggaagctgaggcgggcggatcacctgaggtcaggagttcgagaccagcctggccaacatggcgaaactccgtcactactaaaaatacaaaaattagatgggcgtggtggcaggtgcctgtaatcccatgtactctggaggctgaggtaggagaattgcttgaacccaggaggcagaggttgcagtgagccgagatcgtgccattgcattccagcctgggagacggagcaagactccatctcgaaaaaaaaaaaaatttttctcttaaaatacctacagtaagtggggtgacactattaattgctaagttgctcctgctaaaattggtaagaaatggtatcaagcccctcagttctatttgggtcatctgtttccagagttattatggcctcagaggagagttacatcttctataacaggtaggaagaaccctttgggctgcctttggatgtcgatacaggccccaagggaaacagagtagtagattgttttttcctatatgcatatgatcaaaatacccactttttgatagcctagagaacccaaagcaaacagttgcttaaaaatgctgtttctggctgggcacgatgactcatgcctttaatcccaacactttggaaggctgaggcgggcggatcatgaggtcaggagttcgagaccagcctggccaacatggcgaaaccctgtctctactaaaaatacaaaaattagatgggtgtagtggcacatggctataatcccaggtacttgggaagctgaggtaggagaatcgcttgaacccaggaggcagaggttgcagtgcgctgagatcgtgccactgcactccagcctgggagacagagcgagactccatctcaaaaaaaaaaaaatttttttttatcttatcgtaatacctacagtaagtgactgggtgacactgttaattgctaagttgctgctgctaaaattggtaagaaatggtatcaagctctccagttctgtttgggtcatctctgtttccagagttgttctggcctcagaggagagttacatcttctataacaggtgggaagaaccctttgggctgcctctggatgtcgatacaggccccaagggaaacggagtagtagatttgttttttcctatatgcatatgatcaaaatacccactacttgatagcctagagaaaccaaggcaaatggttgcttaaaaatgctgtttttggctgggcgcggtggctcatgcctaatcctagcactttgggaggccgaggtgggcggatcacaagatcaggagttcaagaccaggctgggcaacatgacgaaatcctgtctctactaaaaatataaaaattaggccaggcacagtggcttatgcctgtaatcccagcactttgggaggctgaggcaggcggatcacaaggtcaggagatcaagaccatcctggctaacacggtgaaaccccatctctactaaaaa

SEQ ID NO: 142880 - DNA, 4694 bp, Homo sapiens
  Payload ID: 8227
  Gene Symbol: INPP5B
  Gene Name: inositol polyphosphate-5-phosphatase B
  Uniprot ID: P32019
  ENST ID: ENST00000373023
  CDS Start-End: 95-3076
aaatgtagtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 142881 - DNA, 3060 bp, Homo sapiens
  Payload ID: 8227
  Gene Symbol: INPP5B
  Gene Name: inositol polyphosphate-5-phosphatase B
  Uniprot ID: P32019
  ENST ID: ENST00000373024
  CDS Start-End: 89-2830
agtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaa

SEQ ID NO: 142882 - DNA, 3230 bp, Homo sapiens
  Payload ID: 8227
  Gene Symbol: INPP5B
  Gene Name: inositol polyphosphate-5-phosphatase B
  Uniprot ID: P32019
  ENST ID: ENST00000373026
  CDS Start-End: 2-2983
catggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacac

SEQ ID NO: 142883 - DNA, 3905 bp, Homo sapiens
  Payload ID: 8227
  Gene Symbol: INPP5B
  Gene Name: inositol polyphosphate-5-phosphatase B
  Uniprot ID: P32019
  ENST ID: ENST00000373027
  CDS Start-End: 38-2287
gcggcgggatgaggagcttgaggaagcaggcagggaaatgtctgccgccgccggctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 142884 - DNA, 3979 bp, Homo sapiens
  Payload ID: 8227
  Gene Symbol: INPP5B
  Gene Name: inositol polyphosphate-5-phosphatase B
  ENST ID: ENST00000458109
  CDS Start-End: 59-2305
gtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 142885 - DNA, 5274 bp, Homo sapiens
  Payload ID: 8228
  Gene Symbol: INPP5D
  Gene Name: inositol polyphosphate-5-phosphatase D
  Uniprot ID: Q92835
  ENST ID: ENST00000359570
  CDS Start-End: 513-4079
ctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 142886 - DNA, 3628 bp, Homo sapiens
  Payload ID: 8228
  Gene Symbol: INPP5D
  Gene Name: inositol polyphosphate-5-phosphatase D
  ENST ID: ENST00000415617
  CDS Start-End: 1-2433
aagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 142887 - DNA, 4845 bp, Homo sapiens
  Payload ID: 8228
  Gene Symbol: INPP5D
  Gene Name: inositol polyphosphate-5-phosphatase D
  Uniprot ID: Q92835
  ENST ID: ENST00000445964
  CDS Start-End: 82-3651
gtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactc

SEQ ID NO: 142888 - DNA, 588 bp, Homo sapiens
  Payload ID: 8228
  Gene Symbol: INPP5D
  Gene Name: inositol polyphosphate-5-phosphatase D
  ENST ID: ENST00000417661
  CDS Start-End: 1-393
aagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagc

SEQ ID NO: 142889 - DNA, 528 bp, Homo sapiens
  Payload ID: 8228
  Gene Symbol: INPP5D
  Gene Name: inositol polyphosphate-5-phosphatase D
  ENST ID: ENST00000491070
  CDS Start-End: 1-130
caccgagctcccgcatcacggcaagcaccggccggaggaggggccaccagggcctctaggcaggactgccatgcaggtgcgctgcgccacacgtgggttcgtgtgcatttgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagccactg

SEQ ID NO: 142890 - DNA, 528 bp, Homo sapiens; identical to SEQ ID NO: 142889
  Payload ID: 8228
  Gene Symbol: INPP5D
  Gene Name: inositol polyphosphate-5-phosphatase D
  ENST ID: ENST00000629792
  CDS Start-End: 1-130

SEQ ID NO: 142891 - DNA, 5274 bp, Homo sapiens; identical to SEQ ID NO: 142885
  Payload ID: 8228
  Gene Symbol: INPP5D
  Gene Name: inositol polyphosphate-5-phosphatase D
  Uniprot ID: Q92835
  ENST ID: ENST00000629761
  CDS Start-End: 513-4079

SEQ ID NO: 142892 - DNA, 4845 bp, Homo sapiens; identical to SEQ ID NO: 142887
  Payload ID: 8228
  Gene Symbol: INPP5D
  Gene Name: inositol polyphosphate-5-phosphatase D
  Uniprot ID: Q92835
  ENST ID: ENST00000630854
  CDS Start-End: 82-3651

SEQ ID NO: 142893 - DNA, 588 bp, Homo sapiens; identical to SEQ ID NO: 142888
  Payload ID: 8228
  Gene Symbol: INPP5D
  Gene Name: inositol polyphosphate-5-phosphatase D
  ENST ID: ENST00000628842
  CDS Start-End: 1-393

SEQ ID NO: 142894 - DNA, 3628 bp, Homo sapiens; identical to SEQ ID NO: 142886
  Payload ID: 8228
  Gene Symbol: INPP5D
  Gene Name: inositol polyphosphate-5-phosphatase D
  ENST ID: ENST00000627169
  CDS Start-End: 1-2433

SEQ ID NO: 142895 - DNA, 3394 bp, Homo sapiens
  Payload ID: 8229
  Gene Symbol: INPP5E
  Gene Name: inositol polyphosphate-5-phosphatase E
  Uniprot ID: Q9NRR6
  ENST ID: ENST00000371712
  CDS Start-End: 404-2338
gccgggctgactccgcttctgggcggccgggcctccgcgagtaccgggtcgacttcggagtctgcgagcccagccaggggtgcccgcttcccacccctctccccgagcggcgtccccgtcggggtcgaacctcccccgcgacaggcgcccagccgcctgttcccccaggccttgcctgcggaccgccctgggaacggcgtctgggagccccgaggggctggcgggactcggggcccgggccatgcggcagccgcccccgcccctccgcgaccatccccggcccaagcgggagccgcagcggcgtttctgctcctcgctgcgccggcgaccccggacccggcacccgtgacccctcgcgctgcctgcggcctcgcgccgaggcctgccccgggagagaccgtccatgccgtccaaggcggagaatctgcggccctccgagccggccccgcagccgccggaagggaggacgctccaaggacagcttcccggcgctccgccggcccagcgcgcggggtccccacccgatgctccgggctccgagagccccgcgcttgcctgcagcactccggccacgcccagcggcgaggacccgccagcccgagcagcacccatcgccccgcggccccccgccaggcctcgactggagcgagccctgtccctggacgacaagggctggaggaggaggcgttttcgaggcagccaggaggacctggaagcccggaatgggaccagtccctccaggggctcagtgcagagcgagggccccggggcccccgcccacagctgctccccgccctgcctgagcacctccttgcaggaaatccccaagtcccgcggggtcctgagcagtgagagagggagcccgtcctcggggggtaaccctctctctggggtggccagcagctccccgaacctcccgcacagagacgccgccgtggcggggagctcgcccaggctgcccagcctgctgcccccgcgcccaccgcctgccctgagcctggacatcgcctccgactccctgaggacagcaaacaaggtcgactcggatcttgcagactacaagctccgcgcgcagccgctcctggtgcgggcccacagcagcctgggccccggccggccgcggagccccctggcctgcgacgactgttcccttcgctcggccaaatcctccttcagcctcctggcgcccatccgcagcaaggacgtccgcagcaggagttacctggagggcagcctcctggccagcggggccctgttgggggcggatgagctggcccgctacttcccagaccggaacgtggcactcttcgtggccacctggaacatgcagggccagaaggagctcccgcccagcctggacgagttcctgctcccagccgaggccgactatgcccaggacctgtatgtcatcggggtccaggagggctgttctgacaggcgggagtgggagactcgtctgcaggagacgctgggcccgcactatgtgctgctgtcctcggcggcccacggcgtgctctacatgtcgctcttcatccgcagggacctcatctggttctgctcagaggtggagtgctccacggtgaccacacgcatcgtgtctcagatcaagaccaagggggccttgggcatcagcttcaccttttttggcacttccttcctcttcatcacgtcccacttcacctcaggtgacgggaaggtggcggagcggctgctggactacaccaggactgtacaagccctggtcctgcccagaaatgtgcccgacaccaacccctatcgctccagcgcagcggacgtcaccacccgcttcgatgaggtgttctggtttggagacttcaacttccgcctgagtggcgggcgcacagtcgtggacgccctcctgtgccagggcctggtggtggacgtgccggcgctgctgcagcacgaccagctcatccgggagatgcggaaagggtccatcttcaagggcttccaggagccggacatccacttcctcccatcatacaagtttgacatcgggaaggacacgtacgacagcacctccaagcagaggacgccctcatacacggaccgcgtcttgtacagaagccgccacaagggtgacatctgtcctgtgagctactcttcctgccccgggatcaagacgtccgaccaccgccctgtgtatggcctcttccgggtgaaagtgaggccggggcgagacaacattccgttggcagctggcaaatttgatagagaactgtacttactaggaattaaaagacggatttcgaaggagattcagaggcagcaagcactacagagtcagaactccagcaccatctgctccgtttcttgaagtttgctgaacgaggactcacagctgcaacgtggggtgattgtattgatcaaaacccactgggaaggacaaagagtttgccgcctttcggggatccgagggactgtggcgaccgtgcctctgtgccagcgtcccaggaaggaagccaaccctgagcgagcctgtcctctgtggcaggtccacacggtgtgggtgggcagggcttggacccccgtctccatggcaggtccatacagcatgggtggcagggtttggacccgcccagcagcaccacggaccccagccactctcgggggcagacgtcagaatccgttcctgagcagctcctgtgccctgggggcagtcacagagccccccaacacccccgtgctctgcaccagcctctccctccacacccgaagcaggcgtccatctgtgtcctcctggcagcccctcaaacacacaccaccccatgtcacacgggtatccagagcaaggctggatctgggctaggtgacccctggggcctcagacctctgagtgggccccagagcccagctgaggaagccacacagcctccaggacgtggcacggttcccctccacttggctgcaagtcgcctgccatggggcgaggaggcctgcaccccagtataagggcctccccagctgagtaagaagctgcttcccctcctctcataggccaagcctattgtgtgaaaccatctcatggtcttggtgacgtagaccatttttgaaaccgtctcatggtcttggtgacgtagaccgtttgcttctttaactccagccgcggaatgacattagtggaaccgggctagggaactgctggaagttcaggatgccaccaccttgaacacctaggccagggatccccaccatgtcccgggtttctttcttcgagagtatagaaccgttcattcttgctttgtgtcccattccatctcttgaaaaaatgtagtctttgaatgtgtgaaaatctagggacattcaatctagtcttttaaattatttttccatatttatatttttaaataaatgcatatattgagtcttaaaa

SEQ ID NO: 142896 - DNA, 5063 bp, Homo sapiens
  Payload ID: 8230
  Gene Symbol: INPP5F
  Gene Name: inositol polyphosphate-5-phosphatase F
  Uniprot ID: Q9Y2H2
  ENST ID: ENST00000361976
  CDS Start-End: 167-3565
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagaagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgtctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtgacaaatgggtatgagaattccttgcataacagattaaagaatttgtaaacggcagatttgctataactgaacacttggtctagctgttgccagtatgttactcctttgaaatatactcatgatgtaaaaagg

SEQ ID NO: 142897 - DNA, 2882 bp, Homo sapiens
  Payload ID: 8230
  Gene Symbol: INPP5F
  Gene Name: inositol polyphosphate-5-phosphatase F
  Uniprot ID: Q9Y2H2
  ENST ID: ENST00000369080
  CDS Start-End: 769-2337
gcattcgccgcattcgctgcaggcgcgaggttgggtgcaggcagctgtttgagcctcgaggcatcgacggacggacagacggacggactgactgacgatgccgcgctctcacaggcctccgcctaccgcgcagcgggctgccactgccgcagcagccgagcccaagtctgagggcgttgtggctatgactttcaagatttttctcctttttgcagggcttatggttaaagttcctgtggggttatatttttcctgcaaattacttcttttccaaagtctgatgttgatgtcccctgaagacagcggcttttatgcgaccattgttgcagtggtcgggcttcatgtggtgctggcaattttcgtcttcatagtgtggaaggagggcttgccccagtggcgggaaaacaaaaacgaatagagcagcttcttcagagctgcagacgtggggggtggggaaatacctaaagggtttttgtcttgtttcttgttcgtattgaacgtgctttttttttttttttttttttttttaaaggggaagggtgggtggggagggaattaaatatttactgcagctaagacttcagtaaaattgggggtggggggagggttgacattttccgactgcctgttacgtgccaagtgctttttgttaaggacataatgtttttgactggggatcatgtttggctgatgtaaatattaatgccaaaataggagctaggatgaaagtaacactgtaattagtagtagaatttatttcatattaaaatgtgtcatgacgtaatttttatggcttggctcaagcaacaattttcagagtgcaccctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattc

SEQ ID NO: 142898 - DNA, 686 bp, Homo sapiens
  Payload ID: 8230
  Gene Symbol: INPP5F
  Gene Name: inositol polyphosphate-5-phosphatase F
  ENST ID: ENST00000490818
  CDS Start-End: 516-686
ggcttggctcaagcaacaattttcagagtgcacgtaagtatcaacgcgtaaaacttaacattttacagtgttatttggtattattctctatgaagctgtctggatcggtctccttttcccattggttaattggttaatgctcagattttggctcctagaatcgatctgtgtgttcccggtcttggcatctcattatgtcatttgctgtattttttgatatattattgtacgtgcaaattgaggtgaatttgttgttttagattaagactgttggactcaagctacaacgaggtgtctctgatgtaaaaaactgcagtttaagattatgcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaactt

SEQ ID NO: 142899 - DNA, 583 bp, Homo sapiens
  Payload ID: 8230
  Gene Symbol: INPP5F
  Gene Name: inositol polyphosphate-5-phosphatase F
  ENST ID: ENST00000631485
  CDS Start-End: 267-583
gtgacttggcactgccgcgtcgcagttgccgcattcgccgcattcgctgcaggcgcgagcaacaattttcagagtgcaccctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatat

SEQ ID NO: 142900 - DNA, 552 bp, Homo sapiens
  Payload ID: 8230
  Gene Symbol: INPP5F
  Gene Name: inositol polyphosphate-5-phosphatase F
  ENST ID: ENST00000631572
  CDS Start-End: 4-552
acgatgccgcgctctcacaggcctccgcctaccgcgcagcgggctgccactgccgcagcagccgagcccaagtctgagggcgttgtggctatgactttcaagatttttctcctttttgcagggcttatggttaaagttcctgtggggttatatttttcctgcaaattacttcttttccaaagtctgatgttgatgtcccctgaagacagcggcttttatgcgaccattgttgcagtggtcgggcttcatgtgcaacaattttcagagtgcaccctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacc

SEQ ID NO: 142901 - DNA, 596 bp, Homo sapiens
  Payload ID: 8230
  Gene Symbol: INPP5F
  Gene Name: inositol polyphosphate-5-phosphatase F
  ENST ID: ENST00000631555
  CDS Start-End: 349-596
acactgtaattagtagtagaatttatttcatattaaaatgtgtcatgacgtaatttttatggcttggctcaagcaacaattttcagagtgcacattaagactgttggactcaagctacaacgaggtgtctctgatgtaaaaaactgcagtttaagattatgcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaa

SEQ ID NO: 142902 - DNA, 3347 bp, Homo sapiens
  Payload ID: 8231
  Gene Symbol: INPP5J
  Gene Name: inositol polyphosphate-5-phosphatase J
  Uniprot ID: Q15735
  ENST ID: ENST00000331075
  CDS Start-End: 50-3070
agagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagctagaaagagggatgccccagcccctagacctctccctgcttctgaggggcatctccagcctccagctcagacatctggtcctacaggctccccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 142903 - DNA, 2393 bp, Homo sapiens
  Payload ID: 8231
  Gene Symbol: INPP5J
  Gene Name: inositol polyphosphate-5-phosphatase J
  Uniprot ID: Q15735
  ENST ID: ENST00000400294
  CDS Start-End: 197-2116
aggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 142904 - DNA, 2215 bp, Homo sapiens
  Payload ID: 8231
  Gene Symbol: INPP5J
  Gene Name: inositol polyphosphate-5-phosphatase J
  Uniprot ID: Q15735
  ENST ID: ENST00000404390
  CDS Start-End: 22-1938
aggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 142905 - DNA, 1751 bp, Homo sapiens
  Payload ID: 8231
  Gene Symbol: INPP5J
  Gene Name: inositol polyphosphate-5-phosphatase J
  ENST ID: ENST00000401755
  CDS Start-End: 419-1534
gggctggaggctctggcaccactcacccactcactacatcccctcgggttggatgggctggaaggatctgggctgagcccttatcctccatggacctgttgacaccccccactgccccccacatctctcccatcccccaccccaaacagcctcgtgttctggttcggggacctgaacttccgcattgagagctatgacctgcactttgtcaagtttgccatcgacagtgaccagctccatcagctctgggagaaggaccaggtggggtccttgtccccagaagcacacagagcatgtcccaggacacgcctgtaccttagactatggtccctgtcctcacctgccccaccccctccctgggcacagcagagcccaagctgttgtccaatctgctctcctggaccccccacagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggag

SEQ ID NO: 142906 - DNA, 2515 bp, Homo sapiens
  Payload ID: 8231
  Gene Symbol: INPP5J
  Gene Name: inositol polyphosphate-5-phosphatase J
  Uniprot ID: Q15735
  ENST ID: ENST00000405300
  CDS Start-End: 319-2238
aggctgccgggggctgcagacatggagggccagagcagcaggggcagcaggaggccagggacccgggctggcctgggttccctgcccatgccccagggtgttgcccaaactggggcaccctccaagacagagaaactgaggcgctgggcagagaggtacttgcctaaggtcacacagagctgggctttgaatctacacagccagtctcagctcccagctcttgctcctgagtggagctctgggaatgggtggactcaagttttcagctcccagcaaagaagaacgcagccctaggaccctcggaaccaagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 142907 - DNA, 1564 bp, Homo sapiens
  Payload ID: 8231
  Gene Symbol: INPP5J
  Gene Name: inositol polyphosphate-5-phosphatase J
  ENST ID: ENST00000402238
  CDS Start-End: 310-1347
ttcctgtagaccggtccctctgcttttcctctgccctttggtgggctggaggctctggcaccactcacccactcactacatcccctcgggttggatgggctggaaggatctgggctgagcccttatcctccatggacctgttgacaccccccactgccccccacatctctcccatcccccaccccaaacagcctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggag

SEQ ID NO: 142908 - DNA, 1613 bp, Homo sapiens
  Payload ID: 8231
  Gene Symbol: INPP5J
  Gene Name: inositol polyphosphate-5-phosphatase J
  ENST ID: ENST00000404453
  CDS Start-End: 281-1396
tctgccctttggtgggctggaggctctggcaccactcacccactcactacatcccctcgggttggatgggctggaaggatctgggctgagcccttatcctccatggacctgttgacaccccccactgccccccacatctctcccatcccccaccccaaacagcctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggag

SEQ ID NO: 142909 - DNA, 3512 bp, Homo sapiens
  Payload ID: 8231
  Gene Symbol: INPP5J
  Gene Name: inositol polyphosphate-5-phosphatase J
  ENST ID: ENST00000412277
  CDS Start-End: 416-3235
caggttgaaatggctgatgacatcactggttcccgggagcggtagagctggagccggagccaagggagtccaggctgccgggggctgcagacatggagggccagagcagcaggggcagcaggaggccagggacccgggctggcctgggttccctgcccatgccccagggtgttgcccaaactggggcaccctccaagacagagaaactgaggcgctgggcagagaggtacttgcctaaggtcacacagagctgggctttgaatctacacagccagtctcagctcccagctcttgctcctgagtggagctctgggaatgggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagctagaaagagggatgccccagcccctagacctctccctgcttctgaggggcatctccagcctccagctcagacatctggtcctacaggctccccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 142910 - DNA, 805 bp, Homo sapiens
  Payload ID: 8231
  Gene Symbol: INPP5J
  Gene Name: inositol polyphosphate-5-phosphatase J
  ENST ID: ENST00000412985
  CDS Start-End: 373-805
agagctggagccggagccaagggagtccaggctgccgggggctgcagacatggagggccagagcagcaggggcagcaggaggccagggacccgggctggcctgggttccctgcccatgccccagggtgttgcccaaactggggcaccctccaagacagagaaactgaggcgctgggcagagaggtacttgcctaaggtcacacagagctgggctttgaatctacacagccagtctcagctcccagctcttgctcctgagtggagctctgggaatgggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctc

SEQ ID NO: 142911 - DNA, 558 bp, Homo sapiens
  Payload ID: 8231
  Gene Symbol: INPP5J
  Gene Name: inositol polyphosphate-5-phosphatase J
  ENST ID: ENST00000420017
  CDS Start-End: 253-558
aagggagtccaggctgccgggggctgcagacatggagggccagagcagcaggggcagcaggaggccagggacccgggctggcctgggttccctgcccatgccccagggtgttgcccaaactggggcaccctccaagttccccagggagtcctgtgaaaggaagcttgagggtgagggagtggtgccaggactacaccctcatatgcccctgccctcaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactgg

SEQ ID NO: 142912 - DNA, 2306 bp, Homo sapiens
  Payload ID: 8231
  Gene Symbol: INPP5J
  Gene Name: inositol polyphosphate-5-phosphatase J
  ENST ID: ENST00000620191
  CDS Start-End: 314-2029
caggttgaaatggctgatgacatcactggttcccgggagcggtagagctggagccggagccaagggagtccaggctgccgggggctgcagacatggagggccagagcagcaggggcagcaggaggccagggacccgggctggcctgggttccctgcccatgccccagggtgttgcccaaactggggcaccctccaagttccccagggagtcctgtgaaaggaagcttgagggtgagggagtggtgccaggactacaccctcatatgcccctgccctcaggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 142913 - DNA, 1505 bp, Homo sapiens
  Payload ID: 8232
  Gene Symbol: INPP5K
  Gene Name: inositol polyphosphate-5-phosphatase K
  ENST ID: ENST00000350761
  CDS Start-End: 120-311
aaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacct

SEQ ID NO: 142914 - DNA, 2880 bp, Homo sapiens
  Payload ID: 8232
  Gene Symbol: INPP5K
  Gene Name: inositol polyphosphate-5-phosphatase K
  Uniprot ID: Q9BT40
  ENST ID: ENST00000320345
  CDS Start-End: 696-1814
agctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcct

SEQ ID NO: 142915 - DNA, 3194 bp, Homo sapiens
  Payload ID: 8232
  Gene Symbol: INPP5K
  Gene Name: inositol polyphosphate-5-phosphatase K
  Uniprot ID: Q9BT40
  ENST ID: ENST00000406424
  CDS Start-End: 862-1980
ctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagaatctccagctgctgcaggtactcctcatcgtgtgcctaggactcatgctaggctgttcctggtctctgcagggtctgtagctcctgcccgctctgtgctccgcacagtctgaggcttcttgaagagctgctgtgactgactgttccactaaagacatctcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttaca

SEQ ID NO: 142916 - DNA, 565 bp, Homo sapiens
  Payload ID: 8232
  Gene Symbol: INPP5K
  Gene Name: inositol polyphosphate-5-phosphatase K
  ENST ID: ENST00000445774
  CDS Start-End: 182-340
cccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattgggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtg

SEQ ID NO: 142917 - DNA, 949 bp, Homo sapiens
  Payload ID: 8232
  Gene Symbol: INPP5K
  Gene Name: inositol polyphosphate-5-phosphatase K
  ENST ID: ENST00000449479
  CDS Start-End: 263-949
gcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattgggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggag

SEQ ID NO: 142918 - DNA, 2988 bp, Homo sapiens
  Payload ID: 8232
  Gene Symbol: INPP5K
  Gene Name: inositol polyphosphate-5-phosphatase K
  Uniprot ID: Q9BT40
  ENST ID: ENST00000421807
  CDS Start-End: 390-1736
acgctgggagctgcggacggcgggcgcgggctgggccgggtctagtggcggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttacacttg

SEQ ID NO: 142919 - DNA, 571 bp, Homo sapiens
  Payload ID: 8232
  Gene Symbol: INPP5K
  Gene Name: inositol polyphosphate-5-phosphatase K
  ENST ID: ENST00000571274
  CDS Start-End: 318-571
atttcttgaagtgcttttgagaacgtcgacctctaaggacggggtctgttggaggagagatgttttggcattaactgcccttttctcccatccccctgtaccctctgccattccagatctccagctgctgcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggct

SEQ ID NO: 142920 - DNA, 566 bp, Homo sapiens
  Payload ID: 8232
  Gene Symbol: INPP5K
  Gene Name: inositol polyphosphate-5-phosphatase K
  ENST ID: ENST00000574955
  CDS Start-End: 163-318
gcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagatctccagctgctgcaggtactcctcatcgtgtgcctaggactcatgctaggctgttcctggtctctgcagggtctgtagctcctgcccgctctgtgctccgcacagtctgaggcttcttgaagagctgctgtgactgactgttccactaaagacatctcatacacgtcgtgacttggaacgtggcttcggcagcgccccctctagatctcagtgacctgcttcagctgaacaaccggaacctcaatcttgacatatatgttattggaatgcttggccgggcgcggtggctcacgcctacaatcccagcactttgagaggccaaggcaggcagatcacctgaggtcgagagttcaagacc

SEQ ID NO: 142921 - DNA, 594 bp, Homo sapiens
  Payload ID: 8232
  Gene Symbol: INPP5K
  Gene Name: inositol polyphosphate-5-phosphatase K
  ENST ID: ENST00000575172
  CDS Start-End: 120-594
aaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactggctcagcattgccaagaaacatgacccgctgctccgggagttccaggagggccgcctactcttcccgcccacctacaagtttgataggaactccaacg

SEQ ID NO: 142922 - DNA, 591 bp, Homo sapiens
  Payload ID: 8232
  Gene Symbol: INPP5K
  Gene Name: inositol polyphosphate-5-phosphatase K
  ENST ID: ENST00000574561
  CDS Start-End: 129-591
gtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcg

SEQ ID NO: 142923 - DNA, 635 bp, Homo sapiens
  Payload ID: 8232
  Gene Symbol: INPP5K
  Gene Name: inositol polyphosphate-5-phosphatase K
  ENST ID: ENST00000573790
  CDS Start-End: 84-383
ccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattgggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgagtgagcctggcctcattatctggtttggagacatgaactttcggatcgaggactttgggttgcactttgttcgggaatccattaaaaatcggtgctacggtggcctg

SEQ ID NO: 142924 - DNA, 629 bp, Homo sapiens
  Payload ID: 8232
  Gene Symbol: INPP5K
  Gene Name: inositol polyphosphate-5-phosphatase K
  ENST ID: ENST00000576646
  CDS Start-End: 1-115
catacacgtcgtgacttggaacgtggcttcggcagcgccccctctagatctcagtgacctgcttcagctgaacaaccggaacctcaatcttgacatatatgttattgggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgagtgagcctggcctcattatctggtttggagacatgaactttcggatcgaggactttgggttgcactttgttcgggaatccattaaaaatcggtgctacggtggcctgtgggagaaggaccagctca

SEQ ID NO: 142925 - DNA, 622 bp, Homo sapiens
  Payload ID: 8232
  Gene Symbol: INPP5K
  Gene Name: inositol polyphosphate-5-phosphatase K
  ENST ID: ENST00000498390
  CDS Start-End: 553-622
gacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattgggtctcccatgtccgtatgcaggggatcctcttactggtctttgccaagtatcagcatttgccctatatccagattctgtctacta

SEQ ID NO: 142926 - DNA, 739 bp, Homo sapiens
  Payload ID: 8232
  Gene Symbol: INPP5K
  Gene Name: inositol polyphosphate-5-phosphatase K
  ENST ID: ENST00000477910
  CDS Start-End: 590-739
agtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagaatctccagctgctgcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgg

SEQ ID NO: 142927 - DNA, 2690 bp, Homo sapiens
  Payload ID: 8233
  Gene Symbol: IMPA1
  Gene Name: inositol(myo)-1(or 4)-monophosphatase 1
  Uniprot ID: P29218
  ENST ID: ENST00000256108
  CDS Start-End: 467-1300
gttagcacctaaaagctgcataatcggaatcatatctgcaatctgggttttgtcaaaatagtactatagaataaatgggagaaagaagaaagcaagctaaatgggaaaccgtgaatgaatggaggacgaaagaagaaaaaggcaaagtaaagagagaagtaatgtttaaaaactgagagatgaaaagacaagcaggagaaaagaaccagaagctagaatgaagaggcagtatcccatgctccagcgcgggtcaggacccggcccggcctggcagaggctcgcagggcgcagctcggggcggggcccagcaaagcaaccacgccccctcaggaatggagtttttaagggcggaacttcctgttgcgagtagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactt

SEQ ID NO: 142928 - DNA, 1106 bp, Homo sapiens
  Payload ID: 8233
  Gene Symbol: IMPA1
  Gene Name: inositol(myo)-1(or 4)-monophosphatase 1
  Uniprot ID: P29218
  ENST ID: ENST00000311489
  CDS Start-End: 75-671
gagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaaggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggt

SEQ ID NO: 142929 - DNA, 1180 bp, Homo sapiens
  Payload ID: 8233
  Gene Symbol: IMPA1
  Gene Name: inositol(myo)-1(or 4)-monophosphatase 1
  Uniprot ID: P29218
  ENST ID: ENST00000449740
  CDS Start-End: 81-1091
cacagagctagccggacgtcctccgactcaagctcctagaaacttggtgcatccccaggcccaggtagtcactctaagtgatggggcagcgcccaggtcctgtgctgcccgcagtcgcggtgctgggacaggtggcaaaaaggaaggtggcctggctcctacgctggaaggctgtgaccaggacagaaacagcaggaaacagttcaggtgtttatggctttgggaaaatgaaaatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgctt

SEQ ID NO: 142930 - DNA, 566 bp, Homo sapiens
  Payload ID: 8233
  Gene Symbol: IMPA1
  Gene Name: inositol(myo)-1(or 4)-monophosphatase 1
  ENST ID: ENST00000521979
  CDS Start-End: 84-413
ggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttc

SEQ ID NO: 142931 - DNA, 617 bp, Homo sapiens
  Payload ID: 8233
  Gene Symbol: IMPA1
  Gene Name: inositol(myo)-1(or 4)-monophosphatase 1
  ENST ID: ENST00000519816
  CDS Start-End: 56-436
acagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaaggtttggaaccgtaggttcttcccccgattatgaggttgatgggagccaaaatgaatttgtggactgtaaaaaaccaacctgtgtgaatatggagagctaaaagggaaatggaagcaatgggagaaggaagaaaaaagcctgaggtgcctaacttttcaggatagaatttggagttgtgtacagttgtgtggaaggcaagatgtacactgccaga

SEQ ID NO: 142932 - DNA, 773 bp, Homo sapiens
  Payload ID: 8233
  Gene Symbol: IMPA1
  Gene Name: inositol(myo)-1(or 4)-monophosphatase 1
  ENST ID: ENST00000518188
  CDS Start-End: 102-407
agtagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacag

SEQ ID NO: 142933 - DNA, 653 bp, Homo sapiens
  Payload ID: 8233
  Gene Symbol: IMPA1
  Gene Name: inositol(myo)-1(or 4)-monophosphatase 1
  ENST ID: ENST00000519964
  CDS Start-End: 112-653
ctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgg

SEQ ID NO: 142934 - DNA, 627 bp, Homo sapiens
  Payload ID: 8233
  Gene Symbol: IMPA1
  Gene Name: inositol(myo)-1(or 4)-monophosphatase 1
  ENST ID: ENST00000518202
  CDS Start-End: 105-627
gcgagtagcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatggagtttccctcttgttggccaggctgagatgcaatggcgcagtcttggctcactgcaacccccacctcccgggttcaagcgattcttctgcctcagcctgccaactgtttcaattggctttgctgtaaataaaaagatagaatttggagttgtgtacagttgtgtggaaggcaagatgtacactgccagaaaaggaaaaggtgccttttgtaatggtc

SEQ ID NO: 142935 - DNA, 793 bp, Homo sapiens
  Payload ID: 8233
  Gene Symbol: IMPA1
  Gene Name: inositol(myo)-1(or 4)-monophosphatase 1
  ENST ID: ENST00000523942
  CDS Start-End: 1-793
ctggaaggctgtgaccaggacagaaacagcaggaaacagttcaggtgtttatggctttgggaaaatgaaaaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggt

SEQ ID NO: 142936 - DNA, 770 bp, Homo sapiens
  Payload ID: 8233
  Gene Symbol: IMPA1
  Gene Name: inositol(myo)-1(or 4)-monophosphatase 1
  ENST ID: ENST00000522997
  CDS Start-End: 137-770
gtagcggttcgctcacgcgacctcacttaacctctgtggcggcttctgtggaataattgcccctttttatgtccccaactccgaaaagctcctagaaacttggtgcatccccaggcccaggtagtcactctaagtgatggggcagcgcccaggtcctgtgctgcccgcagtcgcggtgctgggacaggtggcaaaaaggaaggtggcctggctcctacgctggaaggctgtgaccaggacagaaacagcaggaaacagttcaggtgtttatggctttgggaaaatgaaaatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaag

SEQ ID NO: 142937 - DNA, 543 bp, Homo sapiens
  Payload ID: 8233
  Gene Symbol: IMPA1
  Gene Name: inositol(myo)-1(or 4)-monophosphatase 1
  ENST ID: ENST00000521360
  CDS Start-End: 84-543
ggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatg

SEQ ID NO: 142938 - DNA, 1534 bp, Homo sapiens
  Payload ID: 8234
  Gene Symbol: IMPA2
  Gene Name: inositol(myo)-1(or 4)-monophosphatase 2
  Uniprot ID: O14732
  ENST ID: ENST00000269159
  CDS Start-End: 243-1109
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggccctgtg

SEQ ID NO: 142939 - DNA, 1575 bp, Homo sapiens
  Payload ID: 8234
  Gene Symbol: IMPA2
  Gene Name: inositol(myo)-1(or 4)-monophosphatase 2
  ENST ID: ENST00000383376
  CDS Start-End: 155-412
cgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggtctcctttttctctagtacacatgtgaacccggcacaggaactggatagaaaacctctcggcaaggccacatagtcatgcacagaacagatgtttgcttagcgcctgcccaaggcctcacccttagtgaacttgggacagtccaagagtgtcaaaagcactgccctgaatgctttagatctagtcttttctttgatcctgagaatgcctttggaaggtgtaaacagcggccagctccacagggaccagcctgcagaaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacaggatctcactctgtcacccaggctggagtgcggtggtgcagtcttggctcactgcagcctccacatcctaggttcaagcaattctcctgcctcatcctcctgagtagctgggactacaggcatgcgccaccacatctggctaatttttttgtattttttagtagagacggggtttcaccatgttggccaggctggtctcaaactgctgacctcaagtgagccttttgcctcggcctccgaaagtgctggggttacagttgtgagccactgcacctgaccatatttttaaaatatagagtcgataatgagttatactgggtttttttttttctgtttttttttttctgagatggagtttcactcttgttgcccaggctggagtgcaatggggcgatctcggctcactgcaacctccgcctccctggttcaagtgattttcctcctaagcctcccaagtagctgggattacaggcgcatgccaccatgcccagctaatttttgtatttttagtggagacagggttttgtcatgttggccaggctggtcttgaactcctgacctcaggtgatccacccgcccgggcctcccaaagtattgggattacaggcatgagccaccacacccggcctcaaccccatctcttaaaaaaataaaaagataacctttgctctca

SEQ ID NO: 142940 - DNA, 563 bp, Homo sapiens
  Payload ID: 8234
  Gene Symbol: IMPA2
  Gene Name: inositol(myo)-1(or 4)-monophosphatase 2
  ENST ID: ENST00000586230
  CDS Start-End: 1-379
ccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagagatggggcttcgccatgctgcccaggctggtcttgaagtcctgacctcaaagcgatcggcgcacctcagccttgcaaagtgctgggattacaggcatgaaccaccacgcccagctcatgaatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcaga

SEQ ID NO: 142941 - DNA, 787 bp, Homo sapiens
  Payload ID: 8234
  Gene Symbol: IMPA2
  Gene Name: inositol(myo)-1(or 4)-monophosphatase 2
  ENST ID: ENST00000588927
  CDS Start-End: 488-787
atgaagccgagcggcgaggaccagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtga

SEQ ID NO: 142942 - DNA, 923 bp, Homo sapiens
  Payload ID: 8234
  Gene Symbol: IMPA2
  Gene Name: inositol(myo)-1(or 4)-monophosphatase 2
  ENST ID: ENST00000589238
  CDS Start-End: 566-865
cgctctgcgcgctgcgggacggggcacggcggagcagggttgggtccgcctcgagcggggagggtgatgctgcaccacaggggcggggctggagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctgggg

SEQ ID NO: 142943 - DNA, 895 bp, Homo sapiens
  Payload ID: 8234
  Gene Symbol: IMPA2
  Gene Name: inositol(myo)-1(or 4)-monophosphatase 2
  ENST ID: ENST00000590138
  CDS Start-End: 60-410
ggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaa

SEQ ID NO: 142944 - DNA, 1616 bp, Homo sapiens
  Payload ID: 8234
  Gene Symbol: IMPA2
  Gene Name: inositol(myo)-1(or 4)-monophosphatase 2
  ENST ID: ENST00000590107
  CDS Start-End: 206-697
gggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagaggtgcgggtgtggcccaggtccccagggcccctccctgggctccctctggccatccttcctttctggcttcagcctctgtgcgcctggtttgctgtttgccctgtgccttaatcatgactggcaaatccaagcctcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaa

SEQ ID NO: 142945 - DNA, 500 bp, Homo sapiens
  Payload ID: 8234
  Gene Symbol: IMPA2
  Gene Name: inositol(myo)-1(or 4)-monophosphatase 2
  ENST ID: ENST00000625802
  CDS Start-End: 243-500
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggtctcctttttctctagtacacatgtga

SEQ ID NO: 142946 - DNA, 2420 bp, Homo sapiens
  Payload ID: 8235
  Gene Symbol: ISYNA1
  Gene Name: inositol-3-phosphate synthase 1
  Uniprot ID: Q9NPH2
  ENST ID: ENST00000338128
  CDS Start-End: 219-1895
acttccgccaggcggggacccgatggccacggtggctctgggttgtcgggcctcgaaccgggtctccagacgttgggcccctccctcccagcgcgggagaggcggggaagggggcggggcgggggaggggccgcagcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 142947 - DNA, 1703 bp, Homo sapiens
  Payload ID: 8235
  Gene Symbol: ISYNA1
  Gene Name: inositol-3-phosphate synthase 1
  Uniprot ID: Q9NPH2
  ENST ID: ENST00000457269
  CDS Start-End: 85-1599
agcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttcca

SEQ ID NO: 142948 - DNA, 592 bp, Homo sapiens
  Payload ID: 8235
  Gene Symbol: ISYNA1
  Gene Name: inositol-3-phosphate synthase 1
  ENST ID: ENST00000578352
  CDS Start-End: 61-592
gcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccg

SEQ ID NO: 142949 - DNA, 1466 bp, Homo sapiens
  Payload ID: 8235
  Gene Symbol: ISYNA1
  Gene Name: inositol-3-phosphate synthase 1
  ENST ID: ENST00000577820
  CDS Start-End: 33-173
ctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgacc

SEQ ID NO: 142950 - DNA, 627 bp, Homo sapiens
  Payload ID: 8235
  Gene Symbol: ISYNA1
  Gene Name: inositol-3-phosphate synthase 1
  ENST ID: ENST00000581800
  CDS Start-End: 80-627
ttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtggaccagggggctgaggaaggaggcgtgctggggagagcggggcggctcggggagaagggcacgggacccgggattcactgcgcggcctgtcttcaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggc

SEQ ID NO: 142951 - DNA, 2039 bp, Homo sapiens
  Payload ID: 8235
  Gene Symbol: ISYNA1
  Gene Name: inositol-3-phosphate synthase 1
  ENST ID: ENST00000582811
  CDS Start-End: 133-273
ctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttccacctggggttcttggggcctgtgacctgactctgcctccctctacttccccgactcttgagcgcccagcttcagtcccatcccctctgcccatggtcatcaccccaactcccagggagagcccagaacctggagcctcgctctgcccccagttctcaaaggtggggctagatgggggcggggacggaacaagaccacagggtggagagtgtggtggcagaaggccaaagagggaatctgagacaagctaccaaaaaccaaaaccagcttccatttatttatgggccccaccccctgacgtcctggggagaggggccccccaaagagcctttctctctgggacaaaatacaaatggcaggaagggtccatacagaaaagaacgtctctgaggtccttgcgtttttaataaaatggtaagagtc

SEQ ID NO: 142952 - DNA, 1654 bp, Homo sapiens
  Payload ID: 8235
  Gene Symbol: ISYNA1
  Gene Name: inositol-3-phosphate synthase 1
  ENST ID: ENST00000582770
  CDS Start-End: 80-535
ttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatgctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactca

SEQ ID NO: 142953 - DNA, 629 bp, Homo sapiens
  Payload ID: 8235
  Gene Symbol: ISYNA1
  Gene Name: inositol-3-phosphate synthase 1
  ENST ID: ENST00000583534
  CDS Start-End: 184-629
ttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccga

SEQ ID NO: 142954 - DNA, 793 bp, Homo sapiens
  Payload ID: 8235
  Gene Symbol: ISYNA1
  Gene Name: inositol-3-phosphate synthase 1
  ENST ID: ENST00000581672
  CDS Start-End: 1-701
acaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcaggtgcaccccagcctccagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactca

SEQ ID NO: 142955 - DNA, 1691 bp, Homo sapiens
  Payload ID: 8235
  Gene Symbol: ISYNA1
  Gene Name: inositol-3-phosphate synthase 1
  Uniprot ID: Q9NPH2
  ENST ID: ENST00000578963
  CDS Start-End: 307-1599
gggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttcaccactcccacccgtcacctcgccgtgtctgctgacccccaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactca

SEQ ID NO: 142956 - DNA, 6066 bp, Homo sapiens
  Payload ID: 8236
  Gene Symbol: ITPK1
  Gene Name: inositol-tetrakisphosphate 1-kinase
  Uniprot ID: Q13572
  ENST ID: ENST00000267615
  CDS Start-End: 175-1419
ggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctggggggccggtggactctgcccagtgaagccaggggagtgtcagcaatgaggggcctggacagcgacgcgggacccgcacctgggagcggcagagatggagcccagctcgctaaacgtaccctaagggtgcacgctgaccatctttgatccctggacagtgtccatagagttgtctccccttcggtcacattgtccctggccttggagtttctgcctcagggaaagacccactaaaaccacccgggctctggcggcctcctcttctccagagcatggtggcgctgcctcctgagcagagtcactgagagtgtctgggtccaaggaagggacccacttagcaaaggttgttgtgtggtgctgtgcaggcacggcgcctggagttggccccgccagcatcggggtggcttggggctctggttcctaagcttctgcttctgagttggtcagcacgttggctctgcgccctgcagtgcctgtcttgatggtggtccctggatgtgctgaagggctccaggagcaaggggccagaccacactttggctgagtccttgggtagtttcagagggtcacctgcacagtctgcattgagcaccctggggctgaggccgtgggtcaagttctgcctgacagtgctttgattatatggtgatgtgattctgcaaacataaccccccaactgagtgccagctgctgggtgtccccaccccaagagccaaggggaggccaccctggaactggtgctttgcccttggtgtcatggaggtgtctgggtccacacgtggtgggtgggctgggcctgcagtcacccagcatggccggcgggattggacccagctgcaacctggcaggttccatggggcttcctgtgcctgggcctgcctgtgtctcatgcctgtcaataaaggagaaagcaacctgggaaaaacattcctctctgtacccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccacaactgctgaatggcttcactaatgtccctggggtctgtatctgccctctcttctattccctagaaactctggccgggcatggcggctcacgcctgtcatcccagcacttagggaggctgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctggctgccctaaaggagcacgacccctccagcctggtgaccgggaggcagagaagtgcagctgtccttgacaaaggcccagcctctgctgcctcaggccagcctggccacaccccgatgccacagtcatctgccccgcccaggcataagcctgactcaggtgatacaggcgaggcttctcccatgggtcctccccttgtgagaaagggtctgtgctgtgtaccttctctctgcacagccattgtcagtgtggtttggagtgagtgagcctcccgcactgctcaggggagagctggtgagcatgactccatggcctcctgctggttggggtcttcttctgattctcacccgcaggagcacccagacccccccttttcagaaatgattacattttcccttcaagagtcatctgtgacctggtggtgtggagggactgtcccctcctgcagcctggccgacccccttcctccagggctgtgtggaatcacctctcagaagctcactctgaaaagccactcacagggatttcaccaggatgttgctgttcctgccgacacctgggctttgtgacaaatgctgtttgcttcaagctgttcacaagcaacttcaccagaatcccaagctggttcgtacttaatttgtgtacatacatatgcataatatacatgaccatgtatgagatacagacaccatggcttctgtccattggctcattcgcctggtcgcatgttcactccatgaggttaggacactgcgggtggctttgggatgggtggtttcagggacaaggtgtcgctatgatctctgtatttgctaactagtcttgttttgatttctaacggtctagtggagtacagttaatgttgtgtttatttctgtaactgtaggggtggagtataaacctaacttttggaaacatgaagaaataaacaatagcgccagccgtt

SEQ ID NO: 142957 - DNA, 2803 bp, Homo sapiens
  Payload ID: 8236
  Gene Symbol: ITPK1
  Gene Name: inositol-tetrakisphosphate 1-kinase
  Uniprot ID: Q13572
  ENST ID: ENST00000354313
  CDS Start-End: 290-1234
cgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccacaactgctgaatggcttcactaatgtccctggggtctgtatctgccctctcttctattccctagaaactctggccgggcatggcggctcacgcctgtcatcccagcacttagggaggctgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctggctgccctaaaggagcacgacccctccagcctggtgaccgggaggcagagaagtgcagctgtccttgacaaaggcccagcctctgctgcctcaggccagcctggccacaccccgatgccacagtcatctgccccgcccaggcataagcctgactcaggtgatacaggcgaggcttctcccatgggtcctccccttgtgagaaagggtctgtgctgtgtaccttctctctgcacagccattgtcagtgtggtttggagtgagtgagcctcccgcactgctcaggggagagctggtgagcatgactccatggcctcctgctggttggggtcttcttctgattctcacccgcaggagcacccagacccccccttttcagaaatgattacattttcccttcaagagtcatctgtgacctggtggtgtggagggactgtcccctcctgcagcctggccgacccccttcctccagggctgtgtggaatcacctctcagaagctcactctgaaaagccactcacagggatttcaccaggatgttgctgttcctgccgacacctgggctttgtgacaaatgctgtttgcttcaagctgttcacaagcaacttcaccagaatcccaagctggttcgtacttaatttgtgtacatacatatgcataatatacatgaccatgtatgagatacagacaccatggcttctgtccattggctcattcgcctggtcgcatgttcactccatgaggttaggacactgcgggtggctttgggatgggtggtttcagggacaaggtgtcgctatgatctctgtatttgctaactagtcttgttttgatttctaacggtctagtggagtacagttaatgttgtgtttatttctgtaactgtaggggtggagtataaacctaacttttggaaacatgaagaaataaacaatagcgccagccgtt

SEQ ID NO: 142958 - DNA, 770 bp, Homo sapiens
  Payload ID: 8236
  Gene Symbol: ITPK1
  Gene Name: inositol-tetrakisphosphate 1-kinase
  ENST ID: ENST00000557309
  CDS Start-End: 267-770
ctacgcctaggagggcccctgggtgttcacccacccccccggggggccccatcctgggccagggtccgcttcctcgagggaaggggcgaattcctggaaggtctccttccgggcgcagttgcaatggattgccttgggggtgctgaaccctgctgggggtacagagacgtttccgaaactcagcggctcggtcgcccccaaaggccaggcggaacacacgcccacaccgcggctcccttcccgaagctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgag

SEQ ID NO: 142959 - DNA, 3174 bp, Homo sapiens
  Payload ID: 8236
  Gene Symbol: ITPK1
  Gene Name: inositol-tetrakisphosphate 1-kinase
  Uniprot ID: Q13572
  ENST ID: ENST00000556603
  CDS Start-End: 122-1366
gcgggcaggggcggcgagtgcgcgggcgctcgccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatccca

SEQ ID NO: 142960 - DNA, 667 bp, Homo sapiens
  Payload ID: 8236
  Gene Symbol: ITPK1
  Gene Name: inositol-tetrakisphosphate 1-kinase
  ENST ID: ENST00000554999
  CDS Start-End: 124-667
gatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcag

SEQ ID NO: 142961 - DNA, 3035 bp, Homo sapiens
  Payload ID: 8236
  Gene Symbol: ITPK1
  Gene Name: inositol-tetrakisphosphate 1-kinase
  ENST ID: ENST00000555495
  CDS Start-End: 449-1336
gttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 142962 - DNA, 609 bp, Homo sapiens
  Payload ID: 8236
  Gene Symbol: ITPK1
  Gene Name: inositol-tetrakisphosphate 1-kinase
  ENST ID: ENST00000553452
  CDS Start-End: 106-609
gggcagcgcgcgaggaccaggccgaggaggaagtggcggcggcggcggcggactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgag

SEQ ID NO: 142963 - DNA, 727 bp, Homo sapiens
  Payload ID: 8236
  Gene Symbol: ITPK1
  Gene Name: inositol-tetrakisphosphate 1-kinase
  ENST ID: ENST00000555553
  CDS Start-End: 110-727
gtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaaggcctcccttctgccctagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtg

SEQ ID NO: 142964 - DNA, 2803 bp, Homo sapiens; identical to SEQ ID NO: 142957
  Payload ID: 8236
  Gene Symbol: ITPK1
  Gene Name: inositol-tetrakisphosphate 1-kinase
  Uniprot ID: Q13572
  ENST ID: ENST00000617836
  CDS Start-End: 290-1234

SEQ ID NO: 142965 - DNA, 3174 bp, Homo sapiens; identical to SEQ ID NO: 142959
  Payload ID: 8236
  Gene Symbol: ITPK1
  Gene Name: inositol-tetrakisphosphate 1-kinase
  Uniprot ID: Q13572
  ENST ID: ENST00000614271
  CDS Start-End: 122-1366

SEQ ID NO: 142966 - DNA, 727 bp, Homo sapiens; identical to SEQ ID NO: 142963
  Payload ID: 8236
  Gene Symbol: ITPK1
  Gene Name: inositol-tetrakisphosphate 1-kinase
  ENST ID: ENST00000630564
  CDS Start-End: 110-727

SEQ ID NO: 142967 - DNA, 770 bp, Homo sapiens; identical to SEQ ID NO: 142958
  Payload ID: 8236
  Gene Symbol: ITPK1
  Gene Name: inositol-tetrakisphosphate 1-kinase
  ENST ID: ENST00000625855
  CDS Start-End: 267-770

SEQ ID NO: 142968 - DNA, 667 bp, Homo sapiens; identical to SEQ ID NO: 142960
  Payload ID: 8236
  Gene Symbol: ITPK1
  Gene Name: inositol-tetrakisphosphate 1-kinase
  ENST ID: ENST00000630443
  CDS Start-End: 124-667

SEQ ID NO: 142969 - DNA, 3035 bp, Homo sapiens; identical to SEQ ID NO: 142961
  Payload ID: 8236
  Gene Symbol: ITPK1
  Gene Name: inositol-tetrakisphosphate 1-kinase
  ENST ID: ENST00000626917
  CDS Start-End: 449-1336

SEQ ID NO: 142970 - DNA, 609 bp, Homo sapiens; identical to SEQ ID NO: 142962
  Payload ID: 8236
  Gene Symbol: ITPK1
  Gene Name: inositol-tetrakisphosphate 1-kinase
  ENST ID: ENST00000629384
  CDS Start-End: 106-609

SEQ ID NO: 142971 - DNA, 6066 bp, Homo sapiens; identical to SEQ ID NO: 142956
  Payload ID: 8236
  Gene Symbol: ITPK1
  Gene Name: inositol-tetrakisphosphate 1-kinase
  Uniprot ID: Q13572
  ENST ID: ENST00000626153
  CDS Start-End: 175-1419

SEQ ID NO: 142972 - DNA, 1824 bp, Homo sapiens
  Payload ID: 8237
  Gene Symbol: ITPKA
  Gene Name: inositol-trisphosphate 3-kinase A
  Uniprot ID: P23677
  ENST ID: ENST00000260386
  CDS Start-End: 54-1439
gtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctgaggcggtatctgaaccgcctgcagcagatccgggacaccctggaggtatccgagttcttcaggaggcacgaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaaga

SEQ ID NO: 142973 - DNA, 852 bp, Homo sapiens
  Payload ID: 8237
  Gene Symbol: ITPKA
  Gene Name: inositol-trisphosphate 3-kinase A
  ENST ID: ENST00000425927
  CDS Start-End: 73-852
ggggccttcaactctgctcaggagctcgggccggagaaaggccccgagacttgaagcccttgcccgggagggatgaacacgcaaaggaacccgaggaacgggcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaagga

SEQ ID NO: 142974 - DNA, 5822 bp, Homo sapiens
  Payload ID: 8238
  Gene Symbol: ITPKB
  Gene Name: inositol-trisphosphate 3-kinase B
  Uniprot ID: P27987
  ENST ID: ENST00000272117
  CDS Start-End: 1-2841
atggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 142975 - DNA, 3146 bp, Homo sapiens
  Payload ID: 8238
  Gene Symbol: ITPKB
  Gene Name: inositol-trisphosphate 3-kinase B
  Uniprot ID: P27987
  ENST ID: ENST00000366784
  CDS Start-End: 489-2423
attgaacaaacactgaagtagcccggagcagacactgacaggggcagtatctccacggtcgaaaagggcgtgcagggccggcttggcgtcgccactgccgggatcgccgggcccctgaaccgaagagctttcccccctctttcgcactcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgtgacttcttgggaagtgttcccctcagtggtactgctggggcaacgtccaataccaagaatgatgtatagcatatttcatcttcctacactactctctggaaagactgagccaattacggggtcatctgtaaagtctaagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaa

SEQ ID NO: 142976 - DNA, 6162 bp, Homo sapiens
  Payload ID: 8238
  Gene Symbol: ITPKB
  Gene Name: inositol-trisphosphate 3-kinase B
  Uniprot ID: P27987
  ENST ID: ENST00000429204
  CDS Start-End: 341-3181
cctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggaccccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 142977 - DNA, 3385 bp, Homo sapiens
  Payload ID: 8239
  Gene Symbol: ITPKC
  Gene Name: inositol-trisphosphate 3-kinase C
  Uniprot ID: Q96DU7
  ENST ID: ENST00000263370
  CDS Start-End: 34-2085
gggtcggccgaagcccgaaccgaaggagcgggcatgaggcgctgcccgtgccgtgggagcctgaacgaggcggaggccggggcgctgcccgcggcggcccgcatgggactggaggcgccgcgaggagggcggcggcggcagccgggacagcagcgacctgggcccggcgcaggggccccggcggggcggccggaggggggcgggccctgggcccggacagaggggtccagcctccacagcgagcctgagagggccggcctcgggcctgcgccggggacagagagtccgcaggcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtccctggacagagccatatactgatggctcccagaaaaaacaggatactgaagcagccaggaaacagcctggcactggtggtttccaaatacaacaggatactgatggctcctggacacaacctagcactgacggttcccagacagcacctgggacagactgcctcttgggagagcctgaggatggcccattagaggaaccagagcctggagaattgctgactcacctgtactctcacctgaagtgtagccccctgtgccctgtgccccgcctcatcattacccctgagacccctgagcctgaggcccagccagtgggacccccctcccgggttgaggggggcagcggcggcttctcctctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctggacatgctgggaacttccaggcaggagaggatggtcggattctgaaacgtttctgtcagtgtgagcagcgcagcctggagcagctgatgaaagacccgctgcgacctttcgtgcctgcctactatggcatggtgctgcaggatggccagaccttcaaccagatggaagacctcctggctgactttgagggcccctccattatggactgcaagatgggcagcaggacctatctggaagaggagctagtgaaggcacgggaacgtccccgtccccggaaggacatgtatgagaagatggtggctgtggaccctggggcccctacccctgaggagcatgcccagggtgcagtcaccaagccccgctacatgcagtggagggaaaccatgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaaaagtctgaagggccttgggagaccaggtagcacctggccccatcatgatgcaggggttttggggacctggaaggaaggtgatgaggcagtgagtcagaaaaaccagaacggggtccccggatctgccgggaaggcttctgaggggctgccctgagagcattcagttcacatgtcacagggtatggtgtgacagggtgcctgtggacacatgaatcacttctaacctgcctccctgtcagcctccaggctgccagctggctgaggccagggactgggtcaggctcatctgtggcgcctcagagggtcagcatcattggtgaacagatgcaggcgctgctggaccatctggggagagtgacagtccatgtcttcaccagggagccatttgagtgctgagcgacaagaggctcagagggcatgaccccatgggactggatgcggcctgagggctgataccgctgggcggtatcctgccctgctgtggccctgtgggatcctccgtgttcctcggcggactctgctgacctcctgcagacccaaaccacagccacatcccagcttctgtgccagcactgtgacagtacctcgctcctctgtgcaccagatccggcctcaggacttacacctcctgcctgacccccaggcttctctctcctttctcccagcaaactgcagtggcagaaaggaggttcagaggctgggaaagtgggcctccccttgcaactcagagctgctgcactcaggagggccccatccaatcccgggcccctgcagggaaaagcgctgggtgtgtgtcagaggcgcagggtgggtggggctgccagccaggaccctggcctgcagcctgatccaaaccaaagactgtagaaccctggggtgtggctaacggcccctccagcacccatagccaggtcttcctggcccttgaggctgggctggcggacaggcacctacctcttccttaagctgaagctcccacactgtcttccagggctgaggagatgctctccttttctactgaccatcttgatacttatttatacgagaggcagttgctggacggggtagtactgggaagcaggaggcagaatggctctgctgagcctcctacccatgacaacaccccaataaacagaacattcagagccaa

SEQ ID NO: 142978 - DNA, 582 bp, Homo sapiens
  Payload ID: 8239
  Gene Symbol: ITPKC
  Gene Name: inositol-trisphosphate 3-kinase C
  ENST ID: ENST00000597003
  CDS Start-End: 1-153
atggtgctgcaggatggccagaccttcaaccagatggaagacctcctggctgactttgagggcccctccattatggactgcaagatgggcagcagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccacaccggcctggccaaggtctggatgatagacttcggcaagacggtggccttgcccgaccaccagacgctcagccacaggctgccctgggctgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggac

SEQ ID NO: 142979 - DNA, 2954 bp, Homo sapiens
  Payload ID: 8240
  Gene Symbol: INSC
  Gene Name: inscuteable homolog (Drosophila)
  Uniprot ID: Q1MX18
  ENST ID: ENST00000379554
  CDS Start-End: 47-1786
ggcctctgtaaggagacttggagtcgctgcagccaaggctggagccatgagacggccccctggcaatggagaggcggccagcgaaggtccaggtggctggggtctatggggagtccaggagtccaggaggctgtgctgtgccggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 142980 - DNA, 2878 bp, Homo sapiens
  Payload ID: 8240
  Gene Symbol: INSC
  Gene Name: inscuteable homolog (Drosophila)
  Uniprot ID: Q1MX18
  ENST ID: ENST00000379556
  CDS Start-End: 112-1710
tctggagctccagctgcgccccgccaccactggccgctcgcactaccagcctgtctcgcacgctaaggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 142981 - DNA, 2943 bp, Homo sapiens
  Payload ID: 8240
  Gene Symbol: INSC
  Gene Name: inscuteable homolog (Drosophila)
  ENST ID: ENST00000424273
  CDS Start-End: 77-1777
gttgtgccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggtggagtctcactctgtcaccaggctggagtgcagtggtgcaatctcggctcaatgcaacctccgcctcctgggttcaagtgattcccctgcctcagcctcccaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattccc

SEQ ID NO: 142982 - DNA, 2237 bp, Homo sapiens
  Payload ID: 8240
  Gene Symbol: INSC
  Gene Name: inscuteable homolog (Drosophila)
  Uniprot ID: Q1MX18
  ENST ID: ENST00000528567
  CDS Start-End: 74-1636
gttgtgccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctatggggatacagctgcaggtaaaaaagacaaacatctctgccctcctgctgtggtttttattttggcacattcaaggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgta

SEQ ID NO: 142983 - DNA, 1576 bp, Homo sapiens
  Payload ID: 8240
  Gene Symbol: INSC
  Gene Name: inscuteable homolog (Drosophila)
  Uniprot ID: Q1MX18
  ENST ID: ENST00000525218
  CDS Start-End: 68-1540
ccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 142984 - DNA, 1702 bp, Homo sapiens
  Payload ID: 8240
  Gene Symbol: INSC
  Gene Name: inscuteable homolog (Drosophila)
  Uniprot ID: Q1MX18
  ENST ID: ENST00000530161
  CDS Start-End: 68-1666
ccatcctgccctctattttcagggtcacgaccgctgcaagcaggctttgctgcagattgggatcaacatgatggcactgcctggaggtcgccacctggactccgtcaccctgccgggtcagcggctacacctgatgcaggtggactcagtccagcgctggatggaagatctgaagctcatgaccgagtgcgagtgcatgtgtgtcctgcaggccaagcccatcagcctggaagaggatgcacagggtgacctcatcctggcaggtggccctggccctggagaccccctgcagctgctgctcaaacggggttgggtcattagcacagagctgcgcaggatcgggcagaagctggcccaggaccgctgggcacgggtgcacagcatgagcgtgcgtctgacctgccatgcccgctccatggtcagcgagtacagtgctgtcagcaggaactccttgaaggaaatgggcgagattgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggtcagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaactgtgccaagaggcctcatcaggggaagtcttcctactggcctctgcggcccttgccaacatcacgttctttgacacaatggcctgcgagatgctcctgcagttgaatgccatccgtgttctcctggaagcctgcagtgacaagcagagagtggacacgccttacactcgggaccagattgtgaccatcttggcaaacatgtctgtcctagaacagtgtgcctctgacatcattcaggaaaatggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctca

SEQ ID NO: 142985 - DNA, 1706 bp, Homo sapiens
  Payload ID: 8241
  Gene Symbol: INS-IGF2
  Gene Name: INS-IGF2 readthrough
  Uniprot ID: F8WCM5
  ENST ID: ENST00000356578
  CDS Start-End: 60-662
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaa

SEQ ID NO: 142986 - DNA, 828 bp, Homo sapiens
  Payload ID: 8241
  Gene Symbol: INS-IGF2
  Gene Name: INS-IGF2 readthrough
  Uniprot ID: F8WCM5
  ENST ID: ENST00000397270
  CDS Start-End: 60-662
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagggcctgcagggagggatccagcaggtgactcttcaggctgatttgcccatcccagatagaagccgggagtgttctttcaaaggtgtctttaccttagacactcaataaaatggtaacaca

SEQ ID NO: 142987 - DNA, 503 bp, Homo sapiens
  Payload ID: 8242
  Gene Symbol: INS
  Gene Name: insulin
  Uniprot ID: P01308
  ENST ID: ENST00000250971
  CDS Start-End: 98-430
ccagcagccctcagccctccaggacaggctgcatcagaagaggccatcaagcaggtctgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 142988 - DNA, 597 bp, Homo sapiens
  Payload ID: 8242
  Gene Symbol: INS
  Gene Name: insulin
  Uniprot ID: P01308
  ENST ID: ENST00000381330
  CDS Start-End: 192-524
aaattgcagcctcagcccccagccatctgccgacccccccaccccaggccctaatgggccaggcggcaggggttgagaggtaggggagatgggctctgagactataaagccagcgggggcccagcagccctcagccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 142989 - DNA, 639 bp, Homo sapiens
  Payload ID: 8242
  Gene Symbol: INS
  Gene Name: insulin
  Uniprot ID: P01308
  ENST ID: ENST00000397262
  CDS Start-End: 234-566
tccaggacaggctgcatcagaagaggccatcaagcaggtctgttccaagggcctttgcgtcaggtgggctcaggattccagggtggctggaccccaggccccagctctgcagcagggaggacgtggctgggctcgtgaagcatgtgggggtgagcccaggggccccaaggcagggcacctggccttcagcctgcctcagccctgcctgtctcccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 142990 - DNA, 464 bp, Homo sapiens
  Payload ID: 8242
  Gene Symbol: INS
  Gene Name: insulin
  ENST ID: ENST00000421783
  CDS Start-End: 188-464
aagggcctttgcgtcaggtgggctcaggattccagggtggctggaccccaggccccagctctgcagcagggaggacgtggctgggctcgtgaagcatgtgggggtgagcccaggggccccaaggcagggcacctggccttcagcctgcctcagccctgcctgtctcccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggctggagaactactgcaactagacgcagcccgcaggcagccccacacccgccgcctcctgcaccgagagagatggaataaagcccttgaac

SEQ ID NO: 142991 - DNA, 297 bp, Homo sapiens
  Payload ID: 8242
  Gene Symbol: INS
  Gene Name: insulin
  ENST ID: ENST00000512523
  CDS Start-End: 1-297
atggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcagggcagcctgcagcccttggccctggaggggtccctgcagaagcgtggcattgtggaacaatgctgtaccagcatctgctccctctaccagctggagaactactgcaactag

SEQ ID NO: 142992 - DNA, 2623 bp, Homo sapiens
  Payload ID: 8243
  Gene Symbol: INSIG1
  Gene Name: insulin induced gene 1
  ENST ID: ENST00000344756
  CDS Start-End: 212-748
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacc

SEQ ID NO: 142993 - DNA, 1127 bp, Homo sapiens
  Payload ID: 8243
  Gene Symbol: INSIG1
  Gene Name: insulin induced gene 1
  Uniprot ID: O15503
  ENST ID: ENST00000342407
  CDS Start-End: 99-593
gggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaa

SEQ ID NO: 142994 - DNA, 3010 bp, Homo sapiens
  Payload ID: 8243
  Gene Symbol: INSIG1
  Gene Name: insulin induced gene 1
  Uniprot ID: O15503
  ENST ID: ENST00000340368
  CDS Start-End: 212-1045
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaa

SEQ ID NO: 142995 - DNA, 596 bp, Homo sapiens
  Payload ID: 8243
  Gene Symbol: INSIG1
  Gene Name: insulin induced gene 1
  ENST ID: ENST00000425172
  CDS Start-End: 227-596
atgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatctttt

SEQ ID NO: 142996 - DNA, 1320 bp, Homo sapiens
  Payload ID: 8243
  Gene Symbol: INSIG1
  Gene Name: insulin induced gene 1
  ENST ID: ENST00000476756
  CDS Start-End: 1-718
ctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtctt

SEQ ID NO: 142997 - DNA, 2590 bp, Homo sapiens
  Payload ID: 8244
  Gene Symbol: INSIG2
  Gene Name: insulin induced gene 2
  Uniprot ID: Q9Y5U4
  ENST ID: ENST00000245787
  CDS Start-End: 207-884
gtgggagtggaggaggaagaggcggtagggggtacgggggctggtcccagaagatggcggaggcgggggatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccatatatttcatctgtcactagccagagtgtgaacttgatgattcgaggagtagtgctattttttattggagtatttcttgcattagtgttaaatttacttcagattcagagaaatgtgacgctctttccacctgatgtgattgcaagcatcttttcttctgcatggtgggtacccccatgctgtggcacggcttcagctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttctcatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggt

SEQ ID NO: 142998 - DNA, 574 bp, Homo sapiens
  Payload ID: 8244
  Gene Symbol: INSIG2
  Gene Name: insulin induced gene 2
  ENST ID: ENST00000411929
  CDS Start-End: 205-324
gcagtggagctcgggcggagttgtgggagtggaggaggaagaggcggtagggggtacgggggctggtcccagaagatggcggaggcggggctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtg

SEQ ID NO: 142999 - DNA, 1347 bp, Homo sapiens
  Payload ID: 8244
  Gene Symbol: INSIG2
  Gene Name: insulin induced gene 2
  ENST ID: ENST00000614681
  CDS Start-End: 140-856
ggatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccatatatttcatctgtcactagccagagtgtgaacttgatgattcgaggagtagtgctattttttattggagtatttcttgcattagtgttaaatttacttcagattcagagaaatgtgacgctctttccacctgatgtgattgcaagcatcttttcttctgcatggtgggtacccccatgctgtggcacggcttcagctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtgg

SEQ ID NO: 143000 - DNA, 4721 bp, Homo sapiens
  Payload ID: 8245
  Gene Symbol: INSR
  Gene Name: insulin receptor
  Uniprot ID: P06213
  ENST ID: ENST00000302850
  CDS Start-End: 144-4292
ggggggctgcggcccgcgggtcgcgggcgtggaagagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaa

SEQ ID NO: 143001 - DNA, 8954 bp, Homo sapiens
  Payload ID: 8245
  Gene Symbol: INSR
  Gene Name: insulin receptor
  Uniprot ID: P06213
  ENST ID: ENST00000341500
  CDS Start-End: 41-4153
cgcgcgctctgatccgaggagaccccgcgctcccgcagccatggccaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 143002 - DNA, 653 bp, Homo sapiens
  Payload ID: 8245
  Gene Symbol: INSR
  Gene Name: insulin receptor
  ENST ID: ENST00000600492
  CDS Start-End: 1-459
tacaaagaggccccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggcgagtccagtcatcagctccgctgtaagctgttggccctgcattcaagtaaccagaaccacccgtgagagctgccaccagtaatgtcactcgaagcttccttttttttttttttaattccgaaagtctaaatctgtaattaccaagggaccatttaaacatggttttatttgtaattgtcacaaagttaatatcattaaaaggaaactcactaaggacaaa

SEQ ID NO: 143003 - DNA, 9705 bp, Homo sapiens
  Payload ID: 8246
  Gene Symbol: IRS1
  Gene Name: insulin receptor substrate 1
  Uniprot ID: P35568
  ENST ID: ENST00000305123
  CDS Start-End: 1022-4750
cggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccgggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaccagggctatgtgtcaccttccctaagactcttaccttatctcatattttttgagaacttccagtgttacattatttaactgaatgtaattggcccatttgccttggtgggtgctggcctattagtgattagttaacaaaacacagcgtacagagagcacagaaaagcttaatgacctgctactgaaacacctagccagcagtgaaaatgttaattcttttcttgtttggaaagtatacacgtcttggaattttttccacgtgaaaaacaaatggcaatgaatgcatttaaagatattgccgacagatttttaaatctttttaccaggaaacttcctaaaggttaaatgaattaatgcaaatatcaggctccctctgagtctgtgggagcctctatctctctatcaggaattcgcatccctactattgggaggagcaacattttatttctctgaacgcctaagctccctgggtgggagtggggactacaaggtaggggccagggttggagggcattgtagtggctgctgcctcctgatgaactgtttggggaccccagctctactcaaaagggagcggagataaatggaacccctcacactgctgaggcccgtgttactgttcattcagccaggtggcatgtacctcacagactgttgtgcagtgtccgttattgcagattttaatcatttgcatgctcatcaatttctaagataaatagggtctagagtcataagaatccattgttttcaaggaacttgcagaattacatcatttcctattagtagagagcactacccattttgaaaatctgatatgaaagttgttttttactcttgtaaaaaaagactttcttagtcaaactaacttttcatattttcaagcattctgattcatactcttgctagtggaagaagagagcaagctgccctgctcttttcctttgaggactgaaatagttaaagagaaatcaatgaacaaagtcactcccaaccattttcctgtaaagctggttattatttctcaaggaacctacactttgaatatgtgttaccgagatacctctacatgtggaattatcaacatgttttgaatgagagcagaaatgaacagactggaaaaatctatctcttggtttctatttctctgactttttgagtcgaaaagcataaaggtagaaattcttatttaagctgcttctagtggtgcctgagctggttttgatggtggcatcaaactaccgatttaaaactggaagttgctggtactcaaaccaaaagttcatactctggcgacacgaagggtttcctttgagcaacgtcagctgctgagtccttgtgttcagttcccattgaggagagttggcttttatccatttcaaagcatttgtaggccagccaagggctttcattattgaggcttctagtggcctctggttaacctagaagttagtgggtttttcttgatgacaccaacctctcacagcgtttttccttagagacttaagcagagttttaaaatcctcttttgcgaaaagaacaaatatgttttatgactttgatgatatcttcattctgggcaaaagaatggccctagaaccagctagaagtgaagagaatccattaatgatcaaccacctgagtcaataatgagaaatcagtactgatgttacatttgtggctatttcttgctgactttcaaaggtcaaggactcttgactaatccagtgactgcaaaaatggatctactaaaagtcatctagccagaagtagagatttttaacctttctttccctggcttttgtcttctagctatcatttaaatttgagacatttgaagtattaagaaacaatttttctgtatggtaagaaacagtattttacaatactgaagccctgttttattcaatcttgcatcttgaatacaatataccacaaagtcggaaactttatatttatttactgcaggtggttaaaaaaaggggggaaagggtttcaccatccactgacaacgagagccatgacaaatagtatccatgtgcagtcttccaactgctggtgacaatgaccccatatttggtctcatgctgcttttgcagagcactctgtaggttagtccatcacacaaggaggccctgaatccagacactgtgaattaagaccttggcggggagagatgtgacccttttggtaggaatgggaagaagaatgggtggaagccaatatgaaatttcttctttgcaatgacttgacaggggagttaatgttcctaggatgccatgaatgatgaatgttagttggaggtaatgctgtatatgtgtgtgtgtgtgtgtgtgtgtgtttgtgtgtgtgtatatatatgtgtgtgtgtatatatatgtgacatgtgtgtgtctttgtgtgtgtgtatatatatgtgacgtgtgtgtgggatgtgtgtgtgtatatatagatgaatatatacaaatatatagatatatacacacatatatagatatatatacacatatatagatatatatacacacatatatagatacacatatgtgtgtgtgtgtatatatatatatatatatatatagatgtataggcttgtgagaaacttgagaggaagaagcatgctcttctaggaatgtgaggaaatatgaccttgccaagactaaaagacctctagactgtgagctcagttatggagaacaaaaacagcttcatagtgagtagaacaccgaggataaacactggggccatgggtcctttctgaggcagcgccacagaagatctttgtggtccttccgtagttctgtaagtctgtctcctaagtatgggtagagaatatgtagcctgttgtgtgtctcccactacttgtaaacagagcatcacattaggggcagggaggaggtggaatgatattggaggtgcttaaccctactcgaggaattaattatgaataaagagcttataattagctaacatgactagaaaacacatgacttaggtggagagttagctttcttttctagtttgtgtatgacttgccatttgtgacgtatacaccaaaagatctggtgttttagacttctgccattcacttggcatttaaatctctctttgcttatgctgttaacgagtatgccataggataggacaaattcagtaaacaggaaaacttgtccatatttgcatagacatttgtagggttttttttttctttttctttttagaacttcaccattggcttaagaatgtagttcccaaaacaattttttcttgcaaagtactttccttacacctcttggctacagggtgggccaaattaaacatatatgtattttcatttaatgtatgtgcagtttggtttatcatcttaagatggtggtgctgccccggtgctacttcatctgtgtacacaaagaccaatgcatggtctgtattgctaccaaaacatttactgtatatatgtttataacatgtattatgtatatatgtaatgggtgccaggccaggtatatattttttatttagaagtgtttcacttttccaagttttctttatagtgttatgcttattttcaattttttttttcctgattctgtctggtacttagaattgtagtgtcttcatcatcaattaaagaaaactgtctaaatgaattcatggatgtaaatattagtggtccttaatgtctttgattgctggacatgaaacaaactgccaattaaattttgcggagaca

SEQ ID NO: 143004 - DNA, 8138 bp, Homo sapiens
  Payload ID: 8247
  Gene Symbol: IRS2
  Gene Name: insulin receptor substrate 2
  Uniprot ID: Q9Y4H2
  ENST ID: ENST00000375856
  CDS Start-End: 516-4532
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcagccggggaggggggcggccaccgcccgcgccgggcatcctcaggagccccagagcgcggagggcgcggcgccgccgagcggtgctggcccccgcgggcctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagagtatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgttttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaacaaaaagaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaaatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaatacagtcctgaagattttttctgtacgaattctctgtttaacataaagccaatctacttttagagtttgggagtaagtgaggaaatactaggctcctaaaaatacttggataccccttttaattttaaaacttttattctggaagccaaaaaatacctgccagataacaacatttatgaaaagtaaatgtgttatataacaaaacagaacattcgatgtactctacaaaacagagtccttatgacgtgctggatgccattctaaatacataacaaatattaacttcttgatagctcatgacaatcttaggaggtaagaattgtcatcctcattctacagaggaggagcccgaggtacaaaaatgctaagagacttgtgtgagagcacacagtccatgagtggtaaaaccaggaccgctccccagctctgcagtccagaatctgcttatgcacctctgcttagtgctcccttcctgatgtgcacacagaagatacaccaacgtgtacatcaagaatgctccctccatgacatgcacacagaagatgtaccaatgcatacattaagaatgcttcctccggccgggcgtggtggctcacacctgtaatcccagcactttgggaggctgaggcaggcagatcacctgaggtcaggagttcgagacaagcctgaccaacatggagaaaccccgtctctactaaaaatacaaaattagccaggcgtggtggcgcatgcctgtaatcccagctactcgggaggctgaggcaggagaatggcttgaacccgggaggcagaggttgccgtgagccaagataatgccattgcactccagcctgggcaacaagagcgaaactccgtctcaaaaaaaaaaaaaaaaaagaagaagaatgctgcctccatgacacaaacacagaagaagacataccgatgcatacatcaagaatacaaagaagaaaatcatcagatccaggaaaatgcaattcaggaagcagaaaatagaaaattgatgctgtgaatttttatccaggagagttttacctccttgcttgaaacatttgtccgtgcatccactttgccctaaaatgatagtcatgtaataatgtgtgtgttatcttttgaacaaataaaatcagtgcaatttg

SEQ ID NO: 143005 - DNA, 3928 bp, Homo sapiens
  Payload ID: 8248
  Gene Symbol: IRS4
  Gene Name: insulin receptor substrate 4
  Uniprot ID: O14654
  ENST ID: ENST00000372129
  CDS Start-End: 66-3839
ccccaaccctccctttcctgaattccccctcctcctcgctcaccttaaaaccatcgtgcatcaccatggcgagttgctccttcactcgcgaccaagcgacaagaagactaagaggtgcagcagcggcggcagcggcagctctagcagcagtggtgaccaccccgcttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctgaacaccgaagtggccagcgtggtcgtccagctcctgagcatccgtcgctgtggacactcggagcagtatttcttcttggaagtaggcaggtccactgtcatcggtccgggagagctctggatgcaggtcgatgactgtgtggttgcccaaaacatgcatgagctgtttttggagaagatgagagccttgtgtgcagacgaatacagagcccgctgccgcagctacagcatcagcatcggcgcccacctgttaaccctgctgtccgctaggaggcacctgggcttggtgccgctcgagccgggaggctggctcagaaggtcccgctttgagcagttttgccacctcagggccatcggcgacggggaagacgagatgcttttcaccaggcgcttcgtaacacccagcgagcctgtggcccactccaggcgaggaagactgcacctgcccagagggcgcaggtcaaggagagcggtttcagtgccggccagcttttttcgccgcttagcacccagcccagcacgtccccggcaccctgcagaagccccgaacaatggagctcgcctgtcttctgaagtgtctggttctggctctggcaactttggggaggaaggcaatccccagggcaaagaagatcaggaaggaagcggaggtgactacatgcctatgaacaattggggctcaggaaatggccggggctcaggaggtggccagggctcaaatggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtggtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctctaccaaacccttttcggagctcacctttgggacagaatgacaacagtgagtatgtgccaatgttacctggaaagttcctggggaggggcctagacaaagaagtctcctataactgggaccccaaagatgcagcttcaaagccttcaggtgagggatcattctcaaagcctggagatgggggatcaccttcaaagccttcagatcatgagcccccaaagaataaagctaagagacctaaccgactttcttttattacaaaaggatataaaatcaagccaaaaccacaaaagcccacacatgagcagagagaagctgacagctctagtgactacgtcaacatggacttcactaaaagagagagcaatacaccagctccctctactcaaggactaccagattcgtggggcataattgctgaacccagacagtcagccttttctaattatgtgaatgttgagtttggagtgccatttccaaatccagcaaacgacctctcagatcttttaagagctataccacgtgccaaccccttatctctggacagtgctaggtggccacttcctccccttcccctcagtgctacaggtagcaatgctattgaggaagagggtgactacattgaagtaattttcaactcagcaatgacaccagccatggctcttgctgacagtgccattcgctatgatgctgaaacaggtcgaatctatgtggtcgacccattttctgagtgctgtatggatatttctctctcccccagccgatgttctgaaccaccacctgtagctaggctgctgcaggaagaagagcaggagagaagacgcccacaaagccgttctcaaagtttctttgcagcagccagagccgctgtctctgcttttccaacagacagcctcgagagagacctttccccatcctcagccccggctgtcgcttcggctgcagagccgactttagccctcagccaagttgtagctgcggcctccgcgctcgccgcagccccgggcatcggcgcagcagccgcagctgctggatttgactccgcctctgcccgctggtttcaacctgttgctaatgctgctgatgccgaagcagtaaggggagcccaagacgttgccggtggctcgaaccctggagcccacaacccatctgcaaaccttgccagaggtgataaccaggctggcggggctgccgctgcagctgccgctccggaaccaccacctcgcagtcgccgggtgccaagacccccggagagagaagattctgacaacgacgacgacactcacgtgagaatggattttgccagacgtgataatcagttcgactctcccaaaagaggtcggtaattttagaattaatttccctaaagtgaatggtcattgtctaatgattcgatgcgctacagtctacagtgttagggatactatttcattaa

SEQ ID NO: 143006 - DNA, 5101 bp, Homo sapiens
  Payload ID: 8249
  Gene Symbol: INSRR
  Gene Name: insulin receptor-related receptor
  Uniprot ID: P14616
  ENST ID: ENST00000368195
  CDS Start-End: 398-4291
cccccgctgccctccttgggagcggtccccagcctgctgctccgccctcagggttggctggcctctcggcctgccttttgctcagaaccctgtgtcattttctccctctggaggcccgagactctccctgtcactgtctgcatctctgtccccatctctcaatctcatgctgagtctctctgtctccaactgcctgtcactgtctttgtgtctctgtgactctcatttctttttttctgtctcctgctgtctctgtgtgggattccttgtctctctgcccctgccctccctctcctatctgaaccctggtctctgtgtcccttagggcttatcacaccgttctccccagagtcaccgggaggagagccgggactggacacaagccagggctgggacaatggcagtgcctagtctgtggccctggggagcatgcctgcctgtgatcttcctctccttgggatttggcctggatacagtagaggtgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactgaggggcacctcattccctggctggcctcccatggggagacaggaagggacccgacctctgtggctgagacgcctgaatgttcacccccaccccaactcagggcaagggatggccgagggtggggcagagaacaggagcagggaaggctgtgggggtgggcagaggggtctcaccataggagtttctcagactctgagtccctcgggggagagcaagcagggtcaaagccagaggagtagagatcaggtcagggagagatgtcctgccctcagaggtagggaccccactcagactaggaagagggggcccgcccaccctagaggccctgcccctcagtttggggtctcctctggacaggtagggccagcgacatgtttgaaatcagatgagcaatcagaagcaggcctggggcgctctccatgcatgtatgggaggggggtggggctccacatgactgccttgcttgccactggtttcacctcctcccctcagctccactgaccaggtggcatggggagaacccaggggcctggggagtggttcccagcctgcccgccctcacctcctcctctccttttgccctgcccagggctccccaagcttggtgctccttcctccttttctccaggggcatcccttggagtacagtcaccctttcttcagtccctcccctcaatgattagccctggatgcttaaggctttcagagcctcatcttcctccctcccctcaccctcacccagccccgcccccacccctgcctctcatgggaagactggagaaggcacaataaatgctgaggcctgtttgta

SEQ ID NO: 143007 - DNA, 5877 bp, Homo sapiens
  Payload ID: 8250
  Gene Symbol: IDE
  Gene Name: insulin-degrading enzyme
  Uniprot ID: P14735
  ENST ID: ENST00000265986
  CDS Start-End: 58-3117
ccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacctctcaacatcccagtttgaccagatttcttgctttcattgttcataatgcagaaagcagtgaattatattaacattttaaaagtgtttctgggtaacaatgatttttgtcaaatagaagactcaatttcacaaccttaagaatagatcacttttgtaaaacaagaatctcagtatttgatgttggactccttgctgtgagtattgtcactgactccaaacccagaaagatttgttcctgcccttacagggatgaaaataaaaaggatagaaaaaatatttctctcctctacaatgagtccttacatcttcttgccacatctccagctgcagtttaggcagatatcttgttcaatctctgtcttcttgatccctgtcaaaataatttttctactcatatagtggccagttggctcaggcaggcatttcaagaggaatctgcttgttcctcacttttccagcataggacagtggtccagcccgcacagtcagc

SEQ ID NO: 143008 - DNA, 4480 bp, Homo sapiens
  Payload ID: 8250
  Gene Symbol: IDE
  Gene Name: insulin-degrading enzyme
  Uniprot ID: P14735
  ENST ID: ENST00000371581
  CDS Start-End: 326-1720
agttgtaactgtagtaggtcagtgatacatggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacctctcaacatcccagtttgaccagatttcttgctttcattgttcataatgcagaaagcagtgaattatattaacattttaaaagtgtttctgggtaacaatgatttttgtcaaatagaagactcaatttcacaaccttaagaatagatcacttttgtaaaacaagaatctcagtatttgatgttggactccttgctgtgagtattgtcactgactccaaacccagaaagatttgttcctgcccttacagggatgaaaataaaaaggatagaaaaaatatttctctcctctacaatgagtccttacatcttcttgccacatctccagctgcagtttaggcagatatcttgttcaatctctgtcttcttgatccctgtcaaaataatttttctactcatatagtggccagttggctcaggcaggcatttcaagaggaatctgcttgttcctcacttttccagcataggacagtggtccagcccgcacagtcagc

SEQ ID NO: 143009 - DNA, 772 bp, Homo sapiens
  Payload ID: 8250
  Gene Symbol: IDE
  Gene Name: insulin-degrading enzyme
  ENST ID: ENST00000436178
  CDS Start-End: 1-772
gaattcatcatcagaggaggaagagttcccagtcattgtcttcacttctccagaagtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtgg

SEQ ID NO: 143010 - DNA, 3198 bp, Homo sapiens
  Payload ID: 8250
  Gene Symbol: IDE
  Gene Name: insulin-degrading enzyme
  ENST ID: ENST00000478361
  CDS Start-End: 49-234
agcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtgggaactaccaggttgtttttcaaagcagcggcactattttgcatttccaccagcagtgtgtgaaaattccaatttctctatatccttgacaacacttgctatatgtacttttgttataagccatcctggtgggtatgaagtggtgtctcattggaattttgactttcattttcctgatgaccattgtaagagttttaaaatatattctctaggccgggcgtgttggctcatgcctgtaatcccagcactttgggaggatgaggcaggtggatcacctgcagtcaggagttcaggaccagcctgaccaacaagctcctgcatgtggcatctgaaagctatctgtgaagaggttcaagcaattcttctgcctcagcctcccgagtagctgggattacagtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagctttgataaaattgttggcttttggctgggtgcgatagctcacacctgtaatcctaacattttgggaagccgaggcaggaagatcgcttgagcctaggagttcgagaccagcctggacaacacacccatttgcttatgtggaccccttgcactgtaacatggcctatttgtaccttgagctcctcaaagactcactcaacgagtatgcatatgcagcagagctagcaggcttgagctatgatctccaaaataccatctatgggatgtattcgctacatttatgctgatcctctccattgcaacatgacatacctgtttatcaggttattgaaggatgatttaaaagagtatacatatgcagcacgcctctcaggtttgagctatggcattgcatcaggaatgaatgcaatacttctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatggtgagactttctacttaaagcttaatgctttcttcatttttttcctaaattcattttggtttattctgatattgactgtttatacttttaaataacttgtagttctattaaagctggctgtgtatatgttttataaaaacagtggtgggcaggatggctatagttaacagtaacatatacttttaaataggtagaaggaagatattgaacattcccaacccaaacaaatgataaataaacttgagatgatggatatgcttagtaccctgatgtgatcactatacattatatgtatatataataacattatatactctatgaatatctacaattattatttgtcaattaaaaataaaatgtaaaaaaaca

SEQ ID NO: 143011 - DNA, 755 bp, Homo sapiens
  Payload ID: 8251
  Gene Symbol: INSL3
  Gene Name: insulin-like 3 (Leydig cell)
  Uniprot ID: P51460
  ENST ID: ENST00000317306
  CDS Start-End: 18-413
cggcgccacccaccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcgaccgtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagcagc

SEQ ID NO: 143012 - DNA, 899 bp, Homo sapiens
  Payload ID: 8251
  Gene Symbol: INSL3
  Gene Name: insulin-like 3 (Leydig cell)
  Uniprot ID: P51460
  ENST ID: ENST00000379695
  CDS Start-End: 69-542
cccccagctgggacggcccaggcgcctataaagggggtccccgcttggccccggcgccacccaccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcgaccagagggagtctcactctgtttcccaggctggtctcaaactcctgagctcaagtaatcctcccaccttgaccttccaaagtgttgggattagcgatgtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagca

SEQ ID NO: 143013 - DNA, 758 bp, Homo sapiens
  Payload ID: 8251
  Gene Symbol: INSL3
  Gene Name: insulin-like 3 (Leydig cell)
  ENST ID: ENST00000598577
  CDS Start-End: 1-215
tggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcgaccctgagtttcactctgtccccaggtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagcag

SEQ ID NO: 143014 - DNA, 1952 bp, Homo sapiens
  Payload ID: 8252
  Gene Symbol: INSL4
  Gene Name: insulin-like 4 (placenta)
  Uniprot ID: Q14641
  ENST ID: ENST00000239316
  CDS Start-End: 106-525
agtctggagcccagaagggacacaccagcacagtctggtaggctacagcagcaagtctctaaagaaaggctgagaacacccagaacaggagagttcaggtccaggatggccagcctgttccggtcctatctgccagcaatctggctgctgctgagccaactccttagagaaagcctagcagcagagctgaggggatgtggtccccgatttggaaaacacttgctgtcatattgccccatgcctgagaagacattcaccaccaccccaggagggtggctgctggaatctggacgtcccaaagaaatggtgtcaacctccaacaacaaagatggacaagccttaggtacgacatcagaattcattcctaatttgtcaccagagctgaagaaaccactgtctgaagggcagccatcattgaagaaaataatactttcccgcaaaaagagaagtggacgtcacagatttgatccattctgttgtgaagtaatttgtgacgatggaacttcagttaaattatgtacatagtagagtaatcatggactggacatctcatccattctcatatgtattctcaatgacaaattcactgatgcccaattaaatgattgctgtttattagaacatgagaatcattattagtattcacatgtttcacttgctctgtactaatatagtctctccaaatggaggaagttagatagatggaataagttctagtagttgatagtacaatggggaaattatacttaacaataattcactgtatattccaaaatagctagaagagaattgtaatgattccaacacaaaaaagatgaatgttagtttggatgcatatcccaattaccctgatttgatcattacacattatatacacgtatcaaaatatcacatgtactacaaaaatgtgtataactgtaatatgtgaactacaaacttactggaaataaatttttaaagttttacacacataaacacatacgttcacacacactcactcaagtctcttcatttttcctcttttcacactagaagaaatgtaagagataaaggatctaaccatctctaacatcagctcatagtacggaggaaaagcagtgaaggaatgaactggtgggagaggtattaggcatgttcaccctagggtaaacccagagacctccctagaactttgcccaatgcatatcctccacctgcctctcagcacgctgcctttagaccttcaatcattctataaactcctcttttgtccctggcattactccacatcccctcatcaaagtggtgaattggcacaaatactggcattcctctggctacacatacctcctccctatgtgtctctaaatcctaaatcaaagagtacattttatactctgtcagtgaggttctactagttgtgtttgtttgtttgcaggctaactgaagctgctactacctcattatcaggtcctataaacttaattcaagtggcatgatttgagtagccccctgtgcctgcccataaagtgctctgaatctagtgtgggacatggagaagcaaaggataataagtgcaatgatacttgtaggtcatcatagagactgtaatgatccacaggaatcagggtcgtgtttaatgccaacatgtgaaagaataaatatacagggaacagtgtaggtaagaggagagagcaaaatttccctaaggaaactgatggctgatctgcatcttgaaagacatctaagcagaagagagtgcaaaaagggacaagtagaagcccaggaaaatgcacaaaggcctggaagcatagcatgtgtggaaacagccagagtcagcagggcaggaggtggtgtggagaaaaggaattgtcaagatctggttggaatggagacaggagagaggatctcaaacgattccacacaatgcagctatggggtttaggctgcatcctggagtaaggaagaactgc

SEQ ID NO: 143015 - DNA, 715 bp, Homo sapiens
  Payload ID: 8253
  Gene Symbol: INSL5
  Gene Name: insulin-like 5
  Uniprot ID: Q9Y5Q6
  ENST ID: ENST00000304526
  CDS Start-End: 36-443
ttaccatatcagattcacattcagtcctcagcaaaatgaagggctccattttcactctgtttttattctctgtcctatttgccatctcagaagtgcggagcaaggagtctgtgagactctgtgggctagaatacatacggacagtcatctatatctgtgctagctccaggtggagaaggcatcaggaggggatccctcaagctcagcaagctgagacaggaaactccttccagctcccacataaacgtgagttttctgaggaaaatccagcgcaaaaccttccgaaggtggatgcctcaggggaagaccgtctttggggtggacagatgcccactgaagagctttggaagtcaaagaagcattcagtgatgtcaagacaagatttacaaactttgtgttgcactgatggctgttccatgactgatttgagtgctctttgctaagacaagagcaaatacccaatgggtggcagagctttatcacatgtttaattacagtgttttactgcctggtagaacactaatattgtgttattaaaatgatggcttttgggtaggcaaaacttcttttctaaaaggtatagctgagcggttgaaaccacagtgatctctattttctccctttgccaaggttaatgaactgttcttttcaaattctactaatgctttgaaatttcaaatgctgcgcaaaattgcaataaaaatgctataaacca

SEQ ID NO: 143016 - DNA, 758 bp, Homo sapiens
  Payload ID: 8254
  Gene Symbol: INSL6
  Gene Name: insulin-like 6
  Uniprot ID: Q9Y581
  ENST ID: ENST00000381641
  CDS Start-End: 67-708
agacagggagcagggtccggccgaccgccattgcacaacgcggaggactagcctggggtcacagggatgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttggtaagacaagagaattttcttcatcacataatatcaatgtatatattcatgagaatgcaaaatttcagaagaaacgtagaaacaaaattaaaaccttaagcaatttgttttgggggcatcatccccaaagaaaacgcagaggatattcagaaaagtgttgtcttacaggatgtacaaaagaagaacttagcattgcatgtcttccatatattgattttaaaaggctaaaggaaaaaagatcatcacttgtaactaagatatactaaccatcttagaattttttctaacctaataaaagcttaatacatttatttaa

SEQ ID NO: 143017 - DNA, 1097 bp, Homo sapiens
  Payload ID: 8255
  Gene Symbol: IGF1
  Gene Name: insulin-like growth factor 1 (somatomedin C)
  Uniprot ID: P05019
  ENST ID: ENST00000307046
  CDS Start-End: 183-770
cttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtaaccttttagagaatctcgctaagaaacatggagaaaacggaaaagaaaaatgtaatgccctagaaagcgcaaagaaagacagtggcaaaaatgaaaaaaaaaaataaaaattataaaagaggcaaaaaaagacacactattctctgcctctaaaacacaattaaataaaagaatttaaataaaaa

SEQ ID NO: 143018 - DNA, 7359 bp, Homo sapiens
  Payload ID: 8255
  Gene Symbol: IGF1
  Gene Name: insulin-like growth factor 1 (somatomedin C)
  Uniprot ID: P05019
  ENST ID: ENST00000337514
  CDS Start-End: 265-726
gaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaa

SEQ ID NO: 143019 - DNA, 761 bp, Homo sapiens
  Payload ID: 8255
  Gene Symbol: IGF1
  Gene Name: insulin-like growth factor 1 (somatomedin C)
  Uniprot ID: P05019
  ENST ID: ENST00000392904
  CDS Start-End: 72-548
aatgttcccccagctgtttcctgtctacagtgtctgtgttttgtagataaatactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatt

SEQ ID NO: 143020 - DNA, 444 bp, Homo sapiens
  Payload ID: 8255
  Gene Symbol: IGF1
  Gene Name: insulin-like growth factor 1 (somatomedin C)
  ENST ID: ENST00000392905
  CDS Start-End: 1-420
ttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaacta

SEQ ID NO: 143021 - DNA, 7370 bp, Homo sapiens
  Payload ID: 8255
  Gene Symbol: IGF1
  Gene Name: insulin-like growth factor 1 (somatomedin C)
  Uniprot ID: P05019
  ENST ID: ENST00000456098
  CDS Start-End: 220-696
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 143022 - DNA, 612 bp, Homo sapiens
  Payload ID: 8255
  Gene Symbol: IGF1
  Gene Name: insulin-like growth factor 1 (somatomedin C)
  Uniprot ID: P05019
  ENST ID: ENST00000424202
  CDS Start-End: 151-564
gcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctt

SEQ ID NO: 143023 - DNA, 11803 bp, Homo sapiens
  Payload ID: 8256
  Gene Symbol: IGF1R
  Gene Name: insulin-like growth factor 1 receptor
  Uniprot ID: P08069
  ENST ID: ENST00000268035
  CDS Start-End: 612-4715
gggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 143024 - DNA, 11726 bp, Homo sapiens
  Payload ID: 8256
  Gene Symbol: IGF1R
  Gene Name: insulin-like growth factor 1 receptor
  ENST ID: ENST00000558762
  CDS Start-End: 539-4639
ggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgc

SEQ ID NO: 143025 - DNA, 310 bp, Homo sapiens
  Payload ID: 8256
  Gene Symbol: IGF1R
  Gene Name: insulin-like growth factor 1 receptor
  ENST ID: ENST00000560972
  CDS Start-End: 1-310
aactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatggtgcgattgctgggtgtggtgtcccaaggccagccaacactggtcatcatg

SEQ ID NO: 143026 - DNA, 572 bp, Homo sapiens
  Payload ID: 8256
  Gene Symbol: IGF1R
  Gene Name: insulin-like growth factor 1 receptor
  ENST ID: ENST00000558355
  CDS Start-End: 1-572
atgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcat

SEQ ID NO: 143027 - DNA, 1034 bp, Homo sapiens
  Payload ID: 8256
  Gene Symbol: IGF1R
  Gene Name: insulin-like growth factor 1 receptor
  ENST ID: ENST00000558898
  CDS Start-End: 398-1034
caccaaaaccaagatggtaacgagagtgacctgtgatcgtcctcactgctgcactcccaccagcgccatgagtgtttacatgtcatagcaacatcaggaagttaccctatatggtctaaaatggagagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctg

SEQ ID NO: 143028 - DNA, 525 bp, Homo sapiens
  Payload ID: 8256
  Gene Symbol: IGF1R
  Gene Name: insulin-like growth factor 1 receptor
  ENST ID: ENST00000560144
  CDS Start-End: 1-271
gactcagtacgccgtttacgtcaaggctgtgaccctcaccatggtggagaacgaccatatccgtggggccaagagtgagatcttgtacattcgcaccaatgcttcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatca

SEQ ID NO: 143029 - DNA, 1023 bp, Homo sapiens
  Payload ID: 8257
  Gene Symbol: IGF2
  Gene Name: insulin-like growth factor 2
  Uniprot ID: P01344
  ENST ID: ENST00000381389
  CDS Start-End: 167-709
tccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcgacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaaccc

SEQ ID NO: 143030 - DNA, 1005 bp, Homo sapiens
  Payload ID: 8257
  Gene Symbol: IGF2
  Gene Name: insulin-like growth factor 2
  Uniprot ID: P01344
  ENST ID: ENST00000381392
  CDS Start-End: 107-658
aactggacattagcttctcctgtgaaagagacttccagcttcctcctcctcctcttcctcctcctcctcctgccccagcgagccttctgctgagctgtagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaa

SEQ ID NO: 143031 - DNA, 4527 bp, Homo sapiens
  Payload ID: 8257
  Gene Symbol: IGF2
  Gene Name: insulin-like growth factor 2
  Uniprot ID: P01344
  ENST ID: ENST00000381395
  CDS Start-End: 110-652
gcaaactggacattagcttctcctgtgaaagagacttccagcttcctcctcctcctcttcctcctcctcctcctgccccagcgagccttctgctgagctgtagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 143032 - DNA, 5179 bp, Homo sapiens
  Payload ID: 8257
  Gene Symbol: IGF2
  Gene Name: insulin-like growth factor 2
  Uniprot ID: P01344
  ENST ID: ENST00000381406
  CDS Start-End: 753-1304
cgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 143033 - DNA, 1583 bp, Homo sapiens
  Payload ID: 8257
  Gene Symbol: IGF2
  Gene Name: insulin-like growth factor 2
  Uniprot ID: P01344
  ENST ID: ENST00000434045
  CDS Start-End: 386-1096
cactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaat

SEQ ID NO: 143034 - DNA, 934 bp, Homo sapiens
  Payload ID: 8257
  Gene Symbol: IGF2
  Gene Name: insulin-like growth factor 2
  Uniprot ID: P01344
  ENST ID: ENST00000418738
  CDS Start-End: 121-663
ggcactgaccagcctgcaaactggacattagcttctcctgtgaaagagacttccagcttcctcctcctcctcttcctcctcctcctcctgccccagcgagccttctgctgagctacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccc

SEQ ID NO: 143035 - DNA, 5585 bp, Homo sapiens
  Payload ID: 8257
  Gene Symbol: IGF2
  Gene Name: insulin-like growth factor 2
  Uniprot ID: P01344
  ENST ID: ENST00000416167
  CDS Start-End: 1168-1710
gcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 143036 - DNA, 8274 bp, Homo sapiens
  Payload ID: 8258
  Gene Symbol: IGF2BP1
  Gene Name: insulin-like growth factor 2 mRNA binding protein 1
  Uniprot ID: Q9NZI8
  ENST ID: ENST00000290341
  CDS Start-End: 335-2068
atttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaagccatcatgaagctgaatggccaccagttggagaaccatgccctgaaggtctcctacatccccgatgagcagatagcacagggacctgagaatgggcgccgagggggctttggctctcggggtcagccccgccagggctcacctgtggcagcgggggccccagccaagcagcagcaagtggacatcccccttcggctcctggtgcccacccagtatgtgggtgccattattggcaaggagggggccaccatccgcaacatcacaaaacagacccagtccaagatagacgtgcataggaaggagaacgcaggtgcagctgaaaaagccatcagtgtgcactccacccctgagggctgctcctccgcttgtaagatgatcttggagattatgcataaagaggctaaggacaccaaaacggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctagaggcaggggttgtggggcactcccagccacggcactgttaccttggtggtgggacttggaacccaaccctgagctcccgataaagctaaagtccatcatctggcaaattcagtaaattggagagtacttgcttctgtttgtatctgagaggaatttttaactgacggcttctgtctccatgaatcattatcagcatgatgaaaggtgtgtctaaaaaacaattcagaataccagcagcattgtacagcaaggggtaaataagcttaatttattaatttaccaggcttaattaagatcccatggagtgtttagcccttgtgggagacagaagccatcagttaaatgaggttaggcctctcctcctaatatactgattgacaatgcatattagccaggtaatgcactttagctaccctggacaatgctatcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccatgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactgggcgatcccagcccctccccacccaccctctaatggacctcctcatagaagccccatttcacttttgttttatctacctcttagcaaaacaatagataaattaggtagtggcagctccacttgcttaggttagggggggaaaaagatttctttttccaaaggaaaaaaatattaccttgagaatactttccaaaaaataaaattaaaaaaaaaaaaaccaaaaaaaaaaatttttttttaaaagggagacattttccagtgaccactggattgttttaatttcccaagcttttttttcccccataaataagtttcactctttggcgattttcttcacttgtttaagataacgtgctagctattccaacaggtaacagctttcacagtctgcccctggcctgtctcaccccatcccccaccctattcctgccagtgagtccttcctgtgcttctctcccttctcccctcccagccagctgacttcagtcacccctgtcccccctcccctgccaataagctcccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcaccatt

SEQ ID NO: 143037 - DNA, 1317 bp, Homo sapiens
  Payload ID: 8258
  Gene Symbol: IGF2BP1
  Gene Name: insulin-like growth factor 2 mRNA binding protein 1
  Uniprot ID: Q9NZI8
  ENST ID: ENST00000431824
  CDS Start-End: 1-1317
atgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtga

SEQ ID NO: 143038 - DNA, 3291 bp, Homo sapiens
  Payload ID: 8259
  Gene Symbol: IGF2BP2
  Gene Name: insulin-like growth factor 2 mRNA binding protein 2
  Uniprot ID: Q9Y6M1
  ENST ID: ENST00000346192
  CDS Start-End: 65-1735
cggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaa

SEQ ID NO: 143039 - DNA, 3688 bp, Homo sapiens
  Payload ID: 8259
  Gene Symbol: IGF2BP2
  Gene Name: insulin-like growth factor 2 mRNA binding protein 2
  Uniprot ID: Q9Y6M1
  ENST ID: ENST00000382199
  CDS Start-End: 97-1896
ggggggcggaggaggaggagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaaga

SEQ ID NO: 143040 - DNA, 3426 bp, Homo sapiens
  Payload ID: 8259
  Gene Symbol: IGF2BP2
  Gene Name: insulin-like growth factor 2 mRNA binding protein 2
  ENST ID: ENST00000457616
  CDS Start-End: 53-1870
ggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtttttgccttttccctagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaa

SEQ ID NO: 143041 - DNA, 1711 bp, Homo sapiens
  Payload ID: 8259
  Gene Symbol: IGF2BP2
  Gene Name: insulin-like growth factor 2 mRNA binding protein 2
  Uniprot ID: Q9Y6M1
  ENST ID: ENST00000421047
  CDS Start-End: 71-1681
aggctaagggagagatagctaatgaccggtattgtgtactgagatcagacttcagggatgaagcagctgtatgttctcatgtcctggacactaccacgttgatggctttctaaatccagggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacgga

SEQ ID NO: 143042 - DNA, 4250 bp, Homo sapiens
  Payload ID: 8260
  Gene Symbol: IGF2BP3
  Gene Name: insulin-like growth factor 2 mRNA binding protein 3
  Uniprot ID: O00425
  ENST ID: ENST00000258729
  CDS Start-End: 358-2097
ggccgaagccaaaggggttgggaaggaagagacaaaaagtagttttttcccctcctcctcctcctttctcttgctaatcccgcctcctcctaagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 143043 - DNA, 2988 bp, Homo sapiens
  Payload ID: 8260
  Gene Symbol: IGF2BP3
  Gene Name: insulin-like growth factor 2 mRNA binding protein 3
  ENST ID: ENST00000421467
  CDS Start-End: 346-591
aggggttgggaaggaagagacaaaaagtagttttttcccctcctcctcctcctttctcttgctaatcccgcctcctcctaagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggac

SEQ ID NO: 143044 - DNA, 2126 bp, Homo sapiens
  Payload ID: 8260
  Gene Symbol: IGF2BP3
  Gene Name: insulin-like growth factor 2 mRNA binding protein 3
  Uniprot ID: O00425
  ENST ID: ENST00000619562
  CDS Start-End: 295-891
ggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctcccttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaatt

SEQ ID NO: 143045 - DNA, 14044 bp, Homo sapiens
  Payload ID: 8261
  Gene Symbol: IGF2R
  Gene Name: insulin-like growth factor 2 receptor
  Uniprot ID: P11717
  ENST ID: ENST00000356956
  CDS Start-End: 149-7624
cgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccaggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctcgtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaattgggtgttaccattttttccttgatagtgagacgttcccgagcgagttacccatctgcctgcctgtcttttctttctgttaagtgactgaatttgggttttaactctggtgttctcgttgaccctttatgaggcagcactttcatttttctccagagtctcctggtcgtaggtgttaactttgggtccaatctgccttcccttggctctttctagatccgatttctttaccttctccaggccaacctcggggtgtggtcctgttcatcaaaacaatgaacatggagtttagagtccagtgagtcaataaagcttttttttgtgcaacctgatctaacatggagatgttttctcttgagtaaactcactgagttttccatcttaaattactcagcagtgactgagagctacctgcatggaagcaggaagttactccagtgttataaacaaacttcttagactcaacatcctattctccatccctttttttttcctgtagagtccaaaaacctcaaccgtctcatttttaaattatccaattggagttacctttttaaaaaagttattcttaaggactttccaatacctctcctgaggaagacatgtcaggtcttctaaaagtttacattatgaccaaagaaagatgctggtcctcaggcattctacccagggggctgttctccaggccattcccacctcctgctaagaccatggggagccctctctgtaaggaggggcatatgcagggacctgcccatccccttggtaagctggatggcaaaaaggcatgttgtctgcaccactggctgcctgctaatgtcgctgtcagtggggaaggagaagtgacaacacgtttgagtgcatttgctttgactcttagaaacccaagcctctgaaaaaagagtaactacttgccagctgttgttacagatgatatttttaggaaaacatcccgtgacagcaaatcagaattggactctttttcagagaaatgattttattgatggagtacaacctgggtatttagcttcctttcaacaaaattttttgtgcccctttcttgagactgtccatgaatgacagagacatagaataagaactggggtgctaaagatggaataggcaaaccccacaccaaggaaatccacagtgaagtggaaatctggttcttatgaacattttaagagcatctgaagcctgtacttcaccaaccctaaaataatacgtaacacgagatgattcctcaggaaggaacatatagacatacagacaggagacaacatatagacattagaacttacaggacaaagaactctttttccctgaatcatttgagatgaagtttcttcccatcaccaggcattcctacaaacaaggaccttcacacgactaagatgccacctggtgattaaagaacactttgggctggtccgatccattgtacaagttaaagcactgatgggtacacaggtcttacccctgttggcgatcgggtcacaaggagccagtgtgtgtgtcaccaggaggttgtatggacgagactggatttctggaaatatcctttactgactctgaagaatcccatggctcagggaggtacactcatgtcctttcttacttctccggttccactctgttgactagtagttggcctcttgagccatacttgctgtcagttctggacattgttctgtgagaatggggtcaacgggcagtcgtggtgcaggtgagcttgtgtgcaaggcggcaagatagccacattgagttggggacagtatggcctgggggtgttggataggtaaggcagaagcaagcccagaacttggagcctgttgtgactgtcacagtaaggagtttgaagtcctgaaagcagttgagagctgtaggagggccagattgggcttttgagcaagatagtctagatgaaagtaaagagatggagacgcttcagcaaccagatgggaggttgggcatgggagctgtggctgtgctgagctgagaagcctcagactgcctgcgaggctctctctgggaggaagtcaggtctttctttccttcgtttccttcctttcattcctttcctttccttcctttttcctctttctttctttccttttctctctctctctttttctttctctctttctttcgagatggagtctcgctctgttgccaggctggagtgcagtggcatgatctcggctcactgcaatctctgcctcccgggttcaagggattctcctgcctcagcctccctagtagctgggattaaaggcacgcactgccacgcccggctaatttttgtatttttaatagcgacagggtttcaccgtgttggccaggatggtctcgatctcctgacctcatgatccacctgcctcggcctccgaaagtgctgggattacaggcgtgagccaccgtgcccagccaggtctttttcttaaagagggacagactgaaggtaggctgtgaatggtcagttatttgtatttctttaccttttatgctatcttgtagtttgaccagtttgcaaaacaaattgaataaaaagtaattgataatgttgttttgatgctcagtgtttgagggaaacacaatctagtgaatggggttattggttgtcacacctgggagagtgaaaatgaggggctcacaacccaggtgaggtcatctggtgccactcagccccatcccagagaaagcagccttgggatgctggcctcggtgacaaccaagaagtgatggtgggttgctagagacagggtggagcacagagccctggaaggaagcaggaagtcaggttcaagaaaggacttgtgacctcacccttggcttcagggttttatttttctttcttttaaaacattttgagacaacatgtagacattcaaacttacagaacaaagaactattttttccctgaatcatttgagactaagttccctcctatcaccagacatttctacaaatgaggaccttcacaggactaaggtgccaccatcagaaccacaatatgtggggacggtactgccagctaagccttagtgctgtttcggtgttgacagctgtcacaatgatgcccttttcagtagaggagcctgtgatggtcacgtgttgcaggtgatcattgtgccatttggtttacttctgtctggaaagtttctcctttctgtaacctccatgaccttgacacatgaggtcactcttctcacccgccccacctctgggagggtgcctgatttgccctgccccacccagcggctttaggactcagctcttcaggaacaattagggagagggcccttgggtctaactgcaaaatcatacttgaactagaaaatcccgttggcataggtatggattgtcatatagaaacatttttcgcagtgtgccccgtggaacacttgttctgtatgttgttaacagatgttttgcaaaaaatgaaaaggacctgagctctaataagtttgggaaatgctgaattgaagtgaaacagcttttcttggtgtgagacctttcagagtctttaaaggagagttgctgaccacacgtgaaatcacaatagaaaatggccagcaggcctccaggtaggcagcaattcctagacatttgcctgtgttccctgggggagctggtggcctgtgaccatccactgggaaattcccttctgtggcgaggttctgttgttttccagaggctcccacggagcatgctgggtgggtggtctgtatgagaccacaccgttgatgagcagtgaggcccaaacaggtatatcaaaaaatgctcagcatcgctgatcatcagggaaatgcacatcataaacacagtgagacgttgcctcacacctgccagaatggctactgtcagacgaaagacaacaagtgtgggtgaggatgtggagaaaagcgaacacttgtccacctttggtgagaatgtaaattggtatagccattatggaaaacaggaagttcctgaaaaaattaagaacagctaccaggaatcccacatctgggtgtatatccaaaagaaatgaagtcagtaccttgaagagatctctgcagcccctgttcattgcagcattattcacaatagccaagatagggaaaaagcctcagtgtctactgacaaataaagatggatcaagaaaatgcatgtatgtatacacacacacagtggaataccaagtcttgcagaagaaggaaatcctgtcatttgtgacaacatggatgagctgagagaacattatgctaagtgaaataagccagacacagaaagaaaaataccagatgatctcacttatatgtggaatctaaaaaggttggactcagaagcagagagtggaatggtggttaccaaaggccagagggtgcaggaagtgagcagatgttggtgaaagggtgcagaggttcagctatgcaacatgaatgaattctggagatccactgtgcagcatggtgactatgatactgctttgtgtatttaaaattttcagagagtagatcttgtgttctttcccctctccaaataaaaggaaattatttgaggtgatggatatgtttaactagcttgactggggcaatgattttgtaatgataagtatctcaaaacatcatgttgtacaacataagtatacaattgacccttgaacaatacaggtttgaactctgtgggtccacttacatgcggttttttttttctgtaaaagttacacccgatgcgtcagccccttcttctacctcttccacctctggcacccttggcacagcaagaccaaccccccacttcctcctcctcctcctcagcctactcagggtaaagacaaggatgaagacctttatgatgatccacttccacttaatatataataaatatattttctcctcatgattttcttaaaactttttctgtattttattgtaagaatacagtatataatacatacaacatcgaaaa

SEQ ID NO: 143046 - DNA, 758 bp, Homo sapiens
  Payload ID: 8261
  Gene Symbol: IGF2R
  Gene Name: insulin-like growth factor 2 receptor
  ENST ID: ENST00000475834
  CDS Start-End: 1-556
ttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaaccttggtctaattctttactttgttatgaatttcttgacagtggattgagcgatacgtgtcagaactaagcatttcactgtaggcaaattgtgtcttagttatcaagtaaatgtacaaaaaaact

SEQ ID NO: 143047 - DNA, 1653 bp, Homo sapiens
  Payload ID: 8262
  Gene Symbol: IGFBP1
  Gene Name: insulin-like growth factor binding protein 1
  Uniprot ID: P08833
  ENST ID: ENST00000275525
  CDS Start-End: 297-1076
ttgggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgtta

SEQ ID NO: 143048 - DNA, 1601 bp, Homo sapiens
  Payload ID: 8262
  Gene Symbol: IGFBP1
  Gene Name: insulin-like growth factor binding protein 1
  ENST ID: ENST00000457280
  CDS Start-End: 294-1067
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctata

SEQ ID NO: 143049 - DNA, 1369 bp, Homo sapiens
  Payload ID: 8262
  Gene Symbol: IGFBP1
  Gene Name: insulin-like growth factor binding protein 1
  ENST ID: ENST00000468955
  CDS Start-End: 157-807
cgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgc

SEQ ID NO: 143050 - DNA, 1439 bp, Homo sapiens
  Payload ID: 8263
  Gene Symbol: IGFBP2
  Gene Name: insulin-like growth factor binding protein 2, 36kDa
  Uniprot ID: P18065
  ENST ID: ENST00000233809
  CDS Start-End: 130-1107
ggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 143051 - DNA, 846 bp, Homo sapiens
  Payload ID: 8263
  Gene Symbol: IGFBP2
  Gene Name: insulin-like growth factor binding protein 2, 36kDa
  ENST ID: ENST00000456764
  CDS Start-End: 120-665
gactgtggcaggctggagctgttttcaaggcctccttcacctaggctgtgcatacaaaaggttgaagaaagtataaggagacttaatggacgcttgttggacagacatcacgaagcttcatgccctgcaacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgca

SEQ ID NO: 143052 - DNA, 751 bp, Homo sapiens
  Payload ID: 8263
  Gene Symbol: IGFBP2
  Gene Name: insulin-like growth factor binding protein 2, 36kDa
  ENST ID: ENST00000436812
  CDS Start-End: 1-297
aagcatcaccttggcctggaggagcccaagaagctgcgaccaccccctgccaggcagcttctcgctgagcttgcgtctggcgcgtgcttcgtgggcctgctgtcctcactccgggcgtcccctgctgtctgtgcgtgcagactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttg

SEQ ID NO: 143053 - DNA, 477 bp, Homo sapiens
  Payload ID: 8263
  Gene Symbol: IGFBP2
  Gene Name: insulin-like growth factor binding protein 2, 36kDa
  ENST ID: ENST00000434997
  CDS Start-End: 244-477
caggtttggaaaactgcaatagtcactaagaccattcggggctgtttgggtctagcttggtctagacgggtctgaaactccgcaggacccacccaacaagaagtcattgttccaagccacgtgtcagtggtgggtgataccccaggatggaaggagttggtatgagccgactgaaatctacttgaagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccg

SEQ ID NO: 143054 - DNA, 2262 bp, Homo sapiens
  Payload ID: 8264
  Gene Symbol: IGFBP3
  Gene Name: insulin-like growth factor binding protein 3
  Uniprot ID: P17936
  ENST ID: ENST00000275521
  CDS Start-End: 135-1010
ccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgct

SEQ ID NO: 143055 - DNA, 1050 bp, Homo sapiens
  Payload ID: 8264
  Gene Symbol: IGFBP3
  Gene Name: insulin-like growth factor binding protein 3
  Uniprot ID: P17936
  ENST ID: ENST00000381083
  CDS Start-End: 112-1005
gcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttatttt

SEQ ID NO: 143056 - DNA, 2322 bp, Homo sapiens
  Payload ID: 8264
  Gene Symbol: IGFBP3
  Gene Name: insulin-like growth factor binding protein 3
  ENST ID: ENST00000381086
  CDS Start-End: 133-717
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaata

SEQ ID NO: 143057 - DNA, 571 bp, Homo sapiens
  Payload ID: 8264
  Gene Symbol: IGFBP3
  Gene Name: insulin-like growth factor binding protein 3
  ENST ID: ENST00000448817
  CDS Start-End: 176-571
gggcgcatcttcagatgcgtatttgtgggcccctggggatataaacagcccagcgggtgtaaattaaaccccgcagtgccttggctccctgagacccaaatgtaagtcagaaatgtcccaagacttcgcctgccaacggaattaaattttagaaagctccacgaggtacacacgaatgcggagcgctgtatgccagtttccccgacaccggctcgccgcagggagacctcaccccgagagcggaaggggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaag

SEQ ID NO: 143058 - DNA, 894 bp, Homo sapiens
  Payload ID: 8264
  Gene Symbol: IGFBP3
  Gene Name: insulin-like growth factor binding protein 3
  ENST ID: ENST00000428530
  CDS Start-End: 1-431
tggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatgtgagacagctgaaatagctcagttgggagagcatcagtttgaagatgcagctttttttttctgtaaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatt

SEQ ID NO: 143059 - DNA, 810 bp, Homo sapiens
  Payload ID: 8264
  Gene Symbol: IGFBP3
  Gene Name: insulin-like growth factor binding protein 3
  ENST ID: ENST00000417621
  CDS Start-End: 1-460
gtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctggggctccagggcctcactgtccttggaccagcctcaggggctgggcgtggccactggcccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgaggtct

SEQ ID NO: 143060 - DNA, 2412 bp, Homo sapiens
  Payload ID: 8264
  Gene Symbol: IGFBP3
  Gene Name: insulin-like growth factor binding protein 3
  ENST ID: ENST00000613132
  CDS Start-End: 1-813
atgcagcgggcgcgacccacgctctgggccgctgcgctgactctgctggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaagggg

SEQ ID NO: 143061 - DNA, 792 bp, Homo sapiens
  Payload ID: 8264
  Gene Symbol: IGFBP3
  Gene Name: insulin-like growth factor binding protein 3
  ENST ID: ENST00000615754
  CDS Start-End: 1-792
atgcagcgggcgcgacccacgctctgggccgcttgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtag

SEQ ID NO: 143062 - DNA, 2200 bp, Homo sapiens
  Payload ID: 8265
  Gene Symbol: IGFBP4
  Gene Name: insulin-like growth factor binding protein 4
  Uniprot ID: P22692
  ENST ID: ENST00000269593
  CDS Start-End: 276-1052
cccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgat

SEQ ID NO: 143063 - DNA, 6215 bp, Homo sapiens
  Payload ID: 8266
  Gene Symbol: IGFBP5
  Gene Name: insulin-like growth factor binding protein 5
  Uniprot ID: P24593
  ENST ID: ENST00000233813
  CDS Start-End: 751-1569
ggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaaacgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 143064 - DNA, 718 bp, Homo sapiens
  Payload ID: 8266
  Gene Symbol: IGFBP5
  Gene Name: insulin-like growth factor binding protein 5
  ENST ID: ENST00000449583
  CDS Start-End: 20-718
agggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgggtgtgctccaggagggcagagacacatctgcttcagcctttattactcccctcaccccaaactgcccagccctgggctctggccgtgtgcaccttggcccacgggggctgaccctccggctccttctcctgcagagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgag

SEQ ID NO: 143065 - DNA, 1169 bp, Homo sapiens
  Payload ID: 8267
  Gene Symbol: IGFBP6
  Gene Name: insulin-like growth factor binding protein 6
  Uniprot ID: P24592
  ENST ID: ENST00000301464
  CDS Start-End: 274-996
gggaacaaagcaagaaaaatcagagcaatttgggaagtaaacagaaactggaaagggagagggaaagaagagtggggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtc

SEQ ID NO: 143066 - DNA, 1177 bp, Homo sapiens
  Payload ID: 8267
  Gene Symbol: IGFBP6
  Gene Name: insulin-like growth factor binding protein 6
  ENST ID: ENST00000548547
  CDS Start-End: 283-999
gagattcccgggaacaaagcaagaaaaatcagagcaatttgggaagtaaacagaaactggaaagggagagggaaagaagagtggggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctgg

SEQ ID NO: 143067 - DNA, 712 bp, Homo sapiens
  Payload ID: 8267
  Gene Symbol: IGFBP6
  Gene Name: insulin-like growth factor binding protein 6
  ENST ID: ENST00000548176
  CDS Start-End: 52-462
agctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgtcctgagctctccccggaccctccggaaactttctccagagccaggagcaacctgcagttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcaggtg

SEQ ID NO: 143068 - DNA, 1427 bp, Homo sapiens
  Payload ID: 8268
  Gene Symbol: IGFBP7
  Gene Name: insulin-like growth factor binding protein 7
  Uniprot ID: Q16270
  ENST ID: ENST00000295666
  CDS Start-End: 35-883
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaacacagtacatatttgtcatttttaaaaagccacacaatagaaacaagacaccaagatatttaattatcttgttgactcctgtaaaatagctaaacactcatcattcgcggtgcaatactcatagacataagttcctgaaacaatagtttgcatgcgtaaggcattcgcaccaaagaaatctgaaaagaaaaaacaaatggtaattagcagaattgtattgaagtgaccccacttctctaccccagaaaaagacaaagatctggtactgtagataatgaataaatgagtggagctgagaacacaca

SEQ ID NO: 143069 - DNA, 1251 bp, Homo sapiens
  Payload ID: 8268
  Gene Symbol: IGFBP7
  Gene Name: insulin-like growth factor binding protein 7
  Uniprot ID: Q16270
  ENST ID: ENST00000514062
  CDS Start-End: 35-874
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtacacaataaatctcacagccatttaaaaatgactagtacatttgctttaaaaagaacagaactaagtatgaaagtatcagacgtagctattgatgaaattctgtagttagcaacccataagggcattaagtatgccattaaaatgtacagcatgagactccaaaagattatctggatgggtgactgaacatcgttattatgacttagatgcttttaccttatctaacatgtaagagtcaaaatcaaacttgcctggaatggcttctatttcccatagctttctacctatctacttggcattttccctttgtgttgtgactattaaattcctatttaaaagaaaatgattgtgggcaattctcgcccttcacttttgcttttaaaag

SEQ ID NO: 143070 - DNA, 2116 bp, Homo sapiens
  Payload ID: 8269
  Gene Symbol: IGFALS
  Gene Name: insulin-like growth factor binding protein, acid labile subunit
  Uniprot ID: P35858
  ENST ID: ENST00000215539
  CDS Start-End: 112-1929
aggtgacaggcgcgggctgccccgcagtggggaaatccagagggcaggggtggccggcacagcagacgtaccctccctcgctgcctgcctgcagcctgccctgcatgcaggatggccctgaggaaaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatggggtggaaggcatggcggcccccccagctgtcatcaattaaaggcaaaggcaatcgaatctaa

SEQ ID NO: 143071 - DNA, 2136 bp, Homo sapiens
  Payload ID: 8269
  Gene Symbol: IGFALS
  Gene Name: insulin-like growth factor binding protein, acid labile subunit
  Uniprot ID: P35858
  ENST ID: ENST00000415638
  CDS Start-End: 81-2012
gaaatccagagggcaggggtggccggcacagcagacgtaccctccctcgctgcctgcctgcagcctgccctgcatgcaggatggccctgaggaaagcgggtgacctcgagcctcagttcacacctgagcgccgcttccggctgtgctggtatcaggctcactcgggcagagccctcctcgggccgcctccccaagcctctccccccgcaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaacaggctggcctacctgcagcccgcgctcttcagcggcctggccgagctccgggagctggacctgagcaggaacgcgctgcgggccatcaaggcaaacgtgttcgtgcagctgccccggctccagaaactctacctggaccgcaacctcatcgctgccgtggccccgggcgccttcctgggcctgaaggcgctgcgatggctggacctgtcccacaaccgcgtggctggcctcctggaggacacgttccccggtctgctgggcctgcgtgtgctgcggctgtcccacaacgccatcgccagcctgcggccccgcaccttcaaggacctgcacttcctggaggagctgcagctgggccacaaccgcatccggcagctggctgagcgcagctttgagggcctggggcagcttgaggtgctcacgctagaccacaaccagctccaggaggtcaaggcgggcgctttcctcggcctcaccaacgtggcggtcatgaacctctctgggaactgtctccggaaccttccggagcaggtgttccggggcctgggcaagctgcacagcctgcacctggagggcagctgcctgggacgcatccgcccgcacaccttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagagctgccggcggacgccctgggccccctgcagcgggccttctggctggacgtctcgcacaaccgcctggaggcattgcccaacagcctcttggcaccactggggcggctgcgctacctcagcctcaggaacaactcactgcggaccttcacgccgcagcccccgggcctggagcgcctgtggctggagggtaacccctgggactgtggctgccctctcaaggcgctgcgggacttcgccctgcagaaccccagtgctgtgccccgcttcgtccaggccatctgtgagggggacgattgccagccgcccgcgtacacctacaacaacatcacctgtgccagcccgcccgaggtcgtggggctcgacctgcgggacctcagcgaggcccactttgctccctgctgaccaggtccccggactcaagccccggactcaggcccccacctggctcaccttgtgctggggacaggtcctcagtgtcctcaggggcctgcccagtgcacttgctggaagacgcaagggcctgatg

SEQ ID NO: 143072 - DNA, 730 bp, Homo sapiens
  Payload ID: 8269
  Gene Symbol: IGFALS
  Gene Name: insulin-like growth factor binding protein, acid labile subunit
  ENST ID: ENST00000568221
  CDS Start-End: 86-481
ctttctccccgtggatctataatttctcagaagaggagccgagacgccacctggaaaatgatcaattctcgataaagggaagacgatgacagtgggccggcggcttcccacagctctgcacggggcctgccaggaggcctggccctggcgctgctgctgctgtcctgggtggcactgggcccccgcagcctggagggagcagaccccggaacgccgggggaagccgagggcccagcgtgcccggccgcctgtgtctgcagctacgatgacgacgcggatgagctcagcgtcttctgcagctccaggaacctcacgcgcctgcctgatggagtcccgggcggcacccaagccctgtggctggacggcaacaacctctcgtccgtccccccggcagccttccagaacctctccagcctgggcttcctcaacctgcagggcggccagctgggcagcctggagccacaggcgctgctgggcctagagaacctgtgccacctgcacctggagcggaaccagctgcgcagcctggcactcggcacgtttgcacacacgcccgcgctggcctcgctcggcctcagcaacaaccgtctgagcaggctggaggacgggctcttcgagggcctcggcagcctctgggacctcaacctcggctggaatagcctggcggtgctccccgatgcggcgttccgcggcctgggcagcctgcgcgagctggtgctggcgggcaaca

SEQ ID NO: 143073 - DNA, 1093 bp, Homo sapiens
  Payload ID: 8270
  Gene Symbol: IGFBPL1
  Gene Name: insulin-like growth factor binding protein-like 1
  Uniprot ID: Q8WX77
  ENST ID: ENST00000377694
  CDS Start-End: 24-860
ccgccgctgtcccggagcaagccatgccgcgcttgtctctgctcttgccgctgctgcttctgctgctgctgccgctgctgccgccgctgtccccgagccttgggatccgcgacgtgggcggccggcgccccaagtgtggtccgtgccggccagagggctgcccggcgcctgcgccctgcccggcgcccgggatctcggcgctcgacgagtgcggctgctgcgcccgctgcctgggagccgagggcgcgagctgcgggggccgcgccggcgggcgctgtggccccggcctggtatgcgcgagccaggccgctggggcagcgcccgagggcaccgggctctgcgtgtgcgcgcagcgcggcaccgtctgcggctccgacggtcgctcgtaccccagcgtctgcgcgctgcgcctgcgcgctcggcacacgccccgcgcgcaccccggtcacctgcacaaggcgcgcgacggcccttgcgagttcgctcctgtggtcgtcgttcctccccgaagtgttcacaacgtcaccggggcgcaggtgggcctgtcctgtgaagtgagggctgtgcctaccccagtcatcacgtggagaaaggtcacgaagtcccctgagggcacccaagcactggaggagctgcctggggaccatgtcaatatagctgtccaagtgcgagggggcccttctgaccatgaggccacggcctggattttgatcaaccccctgcgaaaggaggatgagggtgtgtaccagtgccatgcagccaacatggtgggagaggctgagtcccacagcacagtgacggttctagatctgagtaaatacaggagcttccacttcccagctcccgatgaccgcatgtgatggagaaatggtcttagaaacattgatcatgggatgatggaaaagtcaaataacggatctttgtgcttcatgaagagttggaaaacctgtgtgtgtagatgaccccttttgtgtgtttttaaaaattagatgcaaactagatctgtatgcagatgtagtttttagcagggcaaacagtgagaaacggatttgcatgtggcttttttatacttttgaaatgaattgttccatga

SEQ ID NO: 143074 - DNA, 2829 bp, Homo sapiens
  Payload ID: 8271
  Gene Symbol: INSM1
  Gene Name: insulinoma-associated 1
  Uniprot ID: Q01101
  ENST ID: ENST00000310227
  CDS Start-End: 148-1680
gggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcctccccttggcggggagaagctttttttcttgctagtattcgctgtgttcatggtctagaaatgcggtctggtctcgcctcgcctaccaatctctgctctctatgtatgtagcgtacgggttgttttgggtgaatcttgaggaataaatgcctttatatttcacaggctgtaaattgaacttcccacacgattagctttattatggcttgtgaactgctggagtctggctttacctttttgtatgtgaacaaatcaaattgcttaaaaaagagttttctttagtatagccacaaatgccttgaactgttgtctgggattgttttgtggggggagggaagggagtgttccgaagatgctgtagtaactgcctcagtgtttcacgtaagactttttggtttgatcatctttgttgaggtaggactatcagttccctctaaatgtatatgttgatttatgagtaattgttatttattctttatttatttatattaattatgaagattatgatattatttgattgcagatttttttggcgcgctgccccctccccaccctgccactcttgacattccactgtgcgttttagaagagagcctttttctaaagggatctgcttaaagttttaacttttatacctatctgagtgaattacagacaacctatcatttattctgcttcgagggtccccagggcccttgtacaaccgacagctcttacttttaaatgcaatctcttttctacatacattattttcttaattgttagctatttatagaaagcttcaatagaactgtttcaactgtataactatttactattcaaataaaatattttcaaagtcaaa

SEQ ID NO: 143075 - DNA, 3013 bp, Homo sapiens
  Payload ID: 8272
  Gene Symbol: INSM2
  Gene Name: insulinoma-associated 2
  Uniprot ID: Q96T92
  ENST ID: ENST00000307169
  CDS Start-End: 212-1912
cgggagaaagccccgcccccggcgcccgctcccactcctgattggccgggccagcccggggaggcccggcgggaccccggcccgcgtctcagctataaagatagccccggcatgacagccgcggcgaagctcttctagttcatctgctggccggctctcagtccccgtggcgccccctttcctcttgtcccagagcgctctcgactccaccatgccaaggggattcctggtgaagcgaactaaacggacaggcggcttgtaccgagttcgccttgcggagcgtgtcttccctctgctggggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacggactgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgggagtgcccagcaaattttctcgtgcaagcactgcccgtccactttttttagctctccagggctgacccggcacatcaataagtgccacccctcagaaagccggcaagtgctgctgctgcagatgccactgcggcctggctgctgagggacgagagaccaggatgatttcgaggttggccttagaggaaacagatcatgggaatttctgtggggctttcttcaacttgcaagtttactttcattccttcctatgttttaatcccctaaaattctccctgtagtcaatgttccaccagaggagcggacagtgaaatgtaatatccctctctagagcaggtatgtatatggtataaaccttgagatcaaagactgtcagctttaaatccttctcactttccccactaaaataggatttttccccttaaaactctggagaccctaacgaatcctatatgatttgtaattcctatggaaagtcgcggtgaatgcgtgcatgtctcaatgtccacaaaggattctggctaccctttggtagccaatgttttttttgtcttgtcatcacaggcgcctatacagcttctgtctcaatagggtcagatattttgcactgtatattctgtgaattaaaagttatgtgattggtgtcaaacttaaggagattcaagacctggcagaaaatgtaagaggatttttgctgcttttggggtgcatggggatctcccctgtaaactttcctttgcccaattatatgtacatgtccattcttaagttggtgtttggaggtggggaggatgctactttactggagttgagacaccccctaaaattctcaccctcagctattttgtgggcagtattcaggaagagctacttcaaacctttctttaaatggctttttggaaatacagaagtcgtttcctcaagtttgactgttttaatggggtttcacccaaattgtttaatgcttctgctgtaaatgtcatactgtgtattcattatgaaaatatgtacagcttaaggaagatgttaacacctgtaatccactaaggaactgaatggcaatttgctcaatattcagtattttcttttcagcggcaacttgtttttgatttttttaaaaaaccatttcagtgtacattgtgtactaattccctactagccagtttgggacattggctgagcactgcctgacagaaagcccgtatttgtaagatgcttaccaccaaataaatgtacatagactgtg

SEQ ID NO: 143076 - DNA, 1641 bp, Homo sapiens
  Payload ID: 8273
  Gene Symbol: ITM2A
  Gene Name: integral membrane protein 2A
  Uniprot ID: O43736
  ENST ID: ENST00000373298
  CDS Start-End: 145-936
ataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaa

SEQ ID NO: 143077 - DNA, 1698 bp, Homo sapiens
  Payload ID: 8273
  Gene Symbol: ITM2A
  Gene Name: integral membrane protein 2A
  Uniprot ID: O43736
  ENST ID: ENST00000434584
  CDS Start-End: 338-997
gtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctat

SEQ ID NO: 143078 - DNA, 805 bp, Homo sapiens
  Payload ID: 8274
  Gene Symbol: ITM2B
  Gene Name: integral membrane protein 2B
  Uniprot ID: Q9Y287
  ENST ID: ENST00000378549
  CDS Start-End: 159-641
cgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaagctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaa

SEQ ID NO: 143079 - DNA, 10137 bp, Homo sapiens
  Payload ID: 8274
  Gene Symbol: ITM2B
  Gene Name: integral membrane protein 2B
  Uniprot ID: Q9Y287
  ENST ID: ENST00000378565
  CDS Start-End: 204-1004
agtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaccttgaatgatgttgtttaatataaaatgcttttatttttgatggaaaggcaatcaaagcctaaagtttccaaggaacgtaaaataactgtgcttctctgagaatgcccgcctcacaagtggaacattttgagttaataatgatgatttttatgtttctaaggttgcttcctctctgaaataattcagaatccacccccatttaataaaatacctatgattcatttcacctcaagttcctaagacaaaaaatttcaattctgactttaggaggtcagagtttttaaagcttccaactcttaaaggatttagtctagaaaccaattctaattcaaaaggatattatttactcatggcttttcatttcatttcagtaatattgtcagaactttaagtcagtgagttgggtattcaggaattaacaattttagaagacaatatgtttcaataaaatgagaattggtttttcctactttccaggctctaaaattacatgaattttcagggagctgtgaacatttaggagcacattattcattcagcatcttttatatgcccaacatatgatattgtgttgaagatatatctgcaaagaagaaaaaaagccactgccgtcgtggagactcacaatctaggaaaagagagggacagcaaacaactcattacaatacattgggatcagtagtgtgagggagaaaaacaggtctaggttctttggaaaacatttaggagagtcaatgagactttcagaatgtgaagtgcatgggattaggtcatggaagaagaccatgtatgtcatcttgaggacttcattctgtagaccatgggccactattgaagttttgcattttggaaggagcttattagtttgttttcctgttgattatagtagtaatgcagtatcagggtagctgaactgcaataataatcccaacatctcactggcttcatgcagtaggaatatgctttcatcacagtccagtatggcaggcaacctccagactcccagggacccaaacttacactttactaaatgtaattctttcatttgaatttttaaaggtttttgtataatcatcttagtaaaacatttgataattcttcacaacatttgcaatcattgatttggccagattggtctaacatggtacccatgattttacttcatttccagtactattctgataatttcctttagagtcaattgagtagagagtacccctctcacctaagcttagtcatgtcccaggaattttggaactccaactgagatttcaggctcattattcattctagggctgaatgaataatgtgccctttgaacccttgtgccatgctggaaactgtggtcttggtgtggcatggaaaaaccagagggtgagggatgtggatgagaagatgacagagaatcagacatgcagagaggactgccaggtctcccagtgggttccagggagactcagctatccttccctcttcttgagttctgtcttagtccattcgggctactataacaaaataccatagactgagtggctttaaacaacagaagcttgtttctcacagttccagaagctggaaagttcaagatcaagtcacctgcagattcagtgtctgatgaggtcctccttcctcacagaaagctctcttctctctgtgaccttatatcacagatgactctgggttcctcttacaaggacactagttccattcatgggggttccactctcatgacctaacacctctcaaaggccccatttcctaatactgtcaccttgggggtaaggatttcaacatgaattctggggggacacaaacattcaaaccatagcaagttccataatgcaccccatcatatgtgtgtgtgtgtgtatttatttatttatctaagatagctctagtttgctgctttgcaacacattctgcccctattgcattggtttaaaaaaaaagtacagaagtcaagatgagactatataaatcttgacaagttgttggccgtgattgctcttttgtgatgcaggagtgagaatctggagaatctggcttaagaggtggctgagaattaaaataataggcatgaaaatgcttcatacagctctgtacagttgttgacagtgccttttttgaaacctatcactgctatatgttagcaagcaaacactgatcttgttttgtaatgtgtaattgttcacttctgctttccctgtatccctttttagattccacacccatattagtgagaagcaagaaaaaaaaatgtacacagtgtcctaaatgttgtttatctcgaataatagaagtaggagtgtaaaacttaaaggctgattaataatgcaaatgaaaaggcaaatggattattgaatagaaaaggtctagattctatgtttgaatgtggttatgaattaatatgggcagaatctctaagattctgctaagtgaacatttagtagtttactagacatcttctcttccacctagcaaagagtttgttgcccagagttatataaatcctactctattgcacactaatctttgcatgtttaactctttgggacttaggttcctagataaggacttcatgtgtatctatttagaaaaagaacatttcttcatttccacaaagctacacagccatcagttcgttcaatatcttgtccaaagttattgctagcgttcttctttctgagtctttgtggctaatgcttttttgaggaagaagcatgatttagtctcagctctctattgatcattttaggcttttatcttactgaaaaaattaagcacaatttaagattttttttgaaatatttactgaattttgaggccataaattatttcctgatagcacacatgtatgggttgtagattccacacttttaatcttccagccacctattgcagattggttctgagaagcaggatgagtgggagtgggcttaggggtcaaaattgagacctaagtggtataaaacaagataatcctagcttcctcccacttaaaataatttgatgggacttctgtatctgatttttaagcttgcatttgtgtttatattttcattgtaaaaatatcaaataatacagtttttgaaggtaaaaagtaaatgttcccgcccttctaccatcctccttcctcagtcccattccccaacagtttaacgtgcgatacaataatgtgtgacacaaaatgacctagttcttgccctagtgactaagcagatgcaaacgccttcttctttccaaacagtgtggtcttatccccgtcgcaaatggaggatatttaagaaacccaagccagaaaccccacagtcttcacagtcactgtgtcctccacctcctagcagcttcctgctgttctgctctagtggttctctctgcttccccacacccacccgtaagccacaacaatctttccaaaacacgaacttgatggtttcattgtcacaccccagcttaaaacactttcctggcttcccctggttcttaggataaagaccaaaatacttaatgctgcacagtccagtcccaacccactctccagcttcatcttaatcacacccctctttgctcctagtgtcctaccacattgcctgacttactgtttcttggtaaatgctattcttacttcctgaagattatttccatctcctcacccgacacccttcagttagcttccactcaaccttcagaatttagttcaggtgacccttcctcaagagaagattttcctgaaccattaggaaaggcttctcttgtttctcagtctcatagcatcatctgtctcttttttgtgacttgaatataattaatattttatattttgtccttgttgcttgtttggttaatagatttccaccactagactgctcaatacgttagtagggcacctgacacatagttgcagctcttatttattgaatgaatgaatgattccttcccgtaccaccctagtcttgcccactgtcatttttattctgggtattatatttcccaaccagttgtctgactttctcctcagatctcatccccatgggtctgagtgagttgccttgaatataagattcagtgatggtgtcctgctgcacttaagagaaaatccttttttcaagccctaaaatcctgccctcactagacttctctcaccatttctctgtttgcatcctagccttttagttttggcctcatataagcttgcagccctgcctgaaacagttgtctctgtccccactctaccccctgccctccacaaagaaaagttaactcttactcatctttcagatctcagactaaaagtttcctcagagatgccaccatagctctctatttctcatacctttcatgatacttcatcacctgtcttcatgaagtcctcctctagactattagcaaaatgctcatactgtgtcctcagtatttggcacataataggttttcttgacactgaaggaaggaataaacatctggtaactatagctagaaaaaaaggaaatacggtatctacttcactaaaaccaaagggggtttttttgggcagacaatcttcattattcagatggaaattaatgtttgttgaatgaatgagctacatttcatggattaactccatgaaatggagttcagctagtaagggttatactttgaggctatttcatcttgatgggcttgttgttcaaagttagagcctcattttaagtaaaatgttctgtgggggccatattaagattttcatatgacagaagtgtatatatatccacaaatgtttcaagccaagattatgtcttcttccataatgccaccttcttctaggatagtatttttgggccagatggttttccacatttaaaacataccaacattcttttaaggcccagtgattatcaaaagggattggcactacattttaaaatgtaggggggatttttgattgtcacaggactagaggatgccatttgtatttagtagatgaggccaggcaggatgctaaatgtcttaaaagtccgggagtcctgcacaaaaaattactgcccttcttgatttgccaattatgcccctgctgggaagcatgaaaggagagagaagagctttcagaatgtcagggataaatatatccattaagccttcagactaagatgcaggaatagttttccatttgggtatgaatacggcaagttcttagaacatttcttaaaacataattagccaaatactagtgtaacagctacaacttatctagttttaatcaactccagggaacattacactttatttaacccctaattatctgataacccaagttctgtcagaaacactgctgaggcatccaggaagatgagcctgtgaaatttgagaatccttcatgtctctggaatgagtccctagattctagccctgcagctagctgacactctaaaaaattatgagtgccttcctttagctccccatagaaatgtctttgtataaccatggcatgatattattctcttgacttttgttgaggattgatagaaataaaaatgagccagaaatgtttcttcagcttttgtaaagtgctgttaaaagcattatgtcatatctagtacttcttatctaagtattttaaaatttagtgttaggaaaatttttttcacataggatacatgttaatattaggtagtacatctaaagaattcatttgcttcccttttgccttggttgctgggaaactcagagccaaactcggtgcttagattaattactttcagcctaggtttttctgtatatcaccctttcggtagggcttgaagtaacccttcagtttgctcatattttgttgtgagttttatagatagtttacatgcaacgaaatgcatatatcttaagtgttcaactcagtgagttttgacacttttctttgtccatgttaacaatcatcaaaacattttcattgccccagaaaataccattgtgctcctttccggcaaatattccttccctctgctaaaactactttttcatttctatgaccatagttcagtttttggctattcttgaactttatttgaatggaatcgtacatatataatctttttgtttggcttttaaaactcagtataacgttttgacatttgtccatgttgttgcatgactcagcagttctttcttttcagttgctgtgtagtagtccatttcttttggttttgtgtgtgtgtgtgtgctttttaaatttattttttatttttttttttttgagacagagtctggctctgtcaactcaggctggagtgcagtggcatcatctcggctcactgcaatttctgtctcccaggctcaagccatcctctaacctcagcctcccgagtagctaagactctacaggcgtatgccaccatacctagtttgtttttgttattttttttagtacagatggggttttgccatgttgtccaggctggtctcgaactcctgggctcaaagcaatccaccctcctcggcctcccaaagtgctaggattacaagtgtgaggcactgtgccctgccagtattccattttttgtgtataccacaatttatcatttttttctgtgtaggtattttcattgtttccaagttgggaagtatgaataaagttgctatgaacatgcatgtacaagtctttgtagatagctcatgttttaaaaagtgtttgtttaatgatttcattgcaaaatcatctttattgtaaacatatctttttgagggtagattggtaaaatatacataataaatacatgacaatgcaggagtccaagtattattaggtttacagtcataacaaacaccaagaaccatttataaatttcagtttctcattgttttagaatggaaggtctaaccaaatatgtaatgtatcccttcaagtaaactagtataacttgggtaccttctcatataaattccccttaaggcatacgttgctgtcttttccaaattcccattttgcttgtccaataggcattatcagatacaacatgttcaaaggcaaacttgattttcctcccatggtttcctcatctcagctcctttttttttccagttgcacaggctaaaaataggaagtcattctagattcctctctttttcataaacctcacatcaaatccatcagccaatctggtgtgctctaccttcaagatacggattatccagaattcagccgcttctcactgtctctactgctaacatagtagtcaaagctgctatcatctcttgcttggattggtgcaatggcctcacaactgatcttcctgcttccatacttgacccctagagcctcttctaaacagagtagctagagcgatcttttctaaatctaagccacatcatgtcactcccctgctcaaatcccaacattttattcagaataaaagtcgaacaatgccctacctgtaggtaatctaggcctccaaagctcttcttacatcacctcctgtaactctccccctttctcactcctctacagccacacagctgcctcactttcctttgaacgtaccaagggcaatcctgcttcagagcctttgcacttgctgtttctgggccaggaattccacaccctccttccctcacatgtatcccaaggctcactgccttccttcagttaagtctgctggaatgtcacttcattaggtattgcctgatcaccttttctaaagtgagtctcacctccaccctcaatgctggcaatgtctgtctgtagtgtattcttaacaatacagattagcacaatgcaggccagaccatgaagactgtttcaagttcgaggatgggcaaaaataatgactaggacttggctcaagattcctcaaacagccaataaacaatgcaaagaataaatgagagagtaattggagacaagctttcccttggcttcccttcttttctcacagaggcttttccagaaggtggtcatttccatagcccatgtggaatgagatgtccactagggcagagaagcacagaaccgtgggcactgcttcccttcctttaaccctatcatattgctgcccagtgagcaatatggtcattggtcaagaaggcttatgcccaggtatccctgtggctatgagcattgctccttatctatgcctctgctcttagacttttccattctgccctcttaggggccttcctggccatgaccacactaccttatttttctctatagtacttatcaccatctgacatgtatttatgtttgtatttgtttattgtctgtctctacaaataaaatgtaaattccctaaaaa

SEQ ID NO: 143080 - DNA, 596 bp, Homo sapiens
  Payload ID: 8274
  Gene Symbol: ITM2B
  Gene Name: integral membrane protein 2B
  ENST ID: ENST00000607866
  CDS Start-End: 1-161
catttatgcttgcaggtgttattctaggaggagcatacttgtacaaatattttgcacttcaaagtttctctcttgttgcccagactggagtccaatggcgcgatctcggctcactgcaccctctgtctcccggccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaacta

SEQ ID NO: 143081 - DNA, 810 bp, Homo sapiens
  Payload ID: 8274
  Gene Symbol: ITM2B
  Gene Name: integral membrane protein 2B
  ENST ID: ENST00000463839
  CDS Start-End: 1-88
aggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgctctaaaattacatgaattttcagggagctgtgaacatttaggagcacattattcattcagcatcttttatatgcccaacatatgatattgtgttgaagatatatctgcaaagaagaaaaaaagccactgccgtcgtggagactcacaatctaggaaaagagagggacagcaaacaactcattacaatacattgggatcagtagtgtgagggagaaaaacaggtctaggttctttggaaaacatttaggagagtcaatgagactttcagaatgtgaagtgcatgggattaggtcatggaagaagaccatgtatgtcatcttgaggacttcattctgtagaccatgggccactattgaagttttgcattttggaaggagcttattagtttgttttcctgttgattatagtagtaatgcagtatcagggtagctgaactgcaataataatcccaacatctcactggcttcatgcagtaggaatatgctttcatcacagtccagtatggcaggcaacctccagactcccagggacccaaacttacactttactaaatgtaattctttcatttgaatttttaaaggtttttgtataatcatcttagtaaaacatttgataattcttca

SEQ ID NO: 143082 - DNA, 1888 bp, Homo sapiens
  Payload ID: 8275
  Gene Symbol: ITM2C
  Gene Name: integral membrane protein 2C
  Uniprot ID: Q9NQX7
  ENST ID: ENST00000326407
  CDS Start-End: 47-739
ctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 143083 - DNA, 2078 bp, Homo sapiens
  Payload ID: 8275
  Gene Symbol: ITM2C
  Gene Name: integral membrane protein 2C
  Uniprot ID: Q9NQX7
  ENST ID: ENST00000326427
  CDS Start-End: 127-930
ggggttagagagagggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 143084 - DNA, 1889 bp, Homo sapiens
  Payload ID: 8275
  Gene Symbol: ITM2C
  Gene Name: integral membrane protein 2C
  Uniprot ID: Q9NQX7
  ENST ID: ENST00000335005
  CDS Start-End: 79-741
agagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctaggctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 143085 - DNA, 1106 bp, Homo sapiens
  Payload ID: 8275
  Gene Symbol: ITM2C
  Gene Name: integral membrane protein 2C
  ENST ID: ENST00000409704
  CDS Start-End: 203-820
gttgggaagtctcgaatggttgcttatcccagaatgaggagggggcttaagtcccgtactaaagcggcagccaaaagctgaagtccgaagagtgggaggcgtctggttctggtcttcaggtggagaagtgctcgaggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcc

SEQ ID NO: 143086 - DNA, 763 bp, Homo sapiens
  Payload ID: 8275
  Gene Symbol: ITM2C
  Gene Name: integral membrane protein 2C
  ENST ID: ENST00000457215
  CDS Start-End: 223-763
agggaatgcgaagggattatgctacggagaacggatccgagcgtgacggctgaatgaatgagtgagcgagtgagtgagtgagtgagtgagcgagcgagtgagtgactgtgcgagcgagcggcagaaggaactccgacccgccccagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctggg

SEQ ID NO: 143087 - DNA, 563 bp, Homo sapiens
  Payload ID: 8275
  Gene Symbol: ITM2C
  Gene Name: integral membrane protein 2C
  ENST ID: ENST00000418408
  CDS Start-End: 189-563
gaaattgggggctgcgagggacagaggatgtgctgctggcctgcaccggaattgacagaccagaaagtgatgaaatggaaatcagccagaaccgacggcgctgcggcctctggacgtcgggggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaag

SEQ ID NO: 143088 - DNA, 572 bp, Homo sapiens
  Payload ID: 8275
  Gene Symbol: ITM2C
  Gene Name: integral membrane protein 2C
  ENST ID: ENST00000541852
  CDS Start-End: 198-572
attatgctacggagaacggatccgagcgtgacggctgaatgaatgagtgagcgagtgagtgagtgagtgagtgagcgagcgagtgagtgactgtgcgagcgagcggcagaaggaactccgacccgccccaggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaag

SEQ ID NO: 143089 - DNA, 573 bp, Homo sapiens
  Payload ID: 8275
  Gene Symbol: ITM2C
  Gene Name: integral membrane protein 2C
  ENST ID: ENST00000543957
  CDS Start-End: 206-573
agagcccggggtggagcagggttgggaagtctcgaatggttgcttatcccagaatgaggagggggcttaagtcccgtactaaagcggcagccaaaagctgaagtccgaagagtgggaggcgtctggttctggtcttcaggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaa

SEQ ID NO: 143090 - DNA, 501 bp, Homo sapiens
  Payload ID: 8275
  Gene Symbol: ITM2C
  Gene Name: integral membrane protein 2C
  ENST ID: ENST00000620962
  CDS Start-End: 1-501
atgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatga

SEQ ID NO: 143091 - DNA, 6959 bp, Homo sapiens
  Payload ID: 8276
  Gene Symbol: INTS1
  Gene Name: integrator complex subunit 1
  Uniprot ID: Q8N201
  ENST ID: ENST00000404767
  CDS Start-End: 87-6659
gtggccgggtggcggcggcggcgctccggtcgcgatgggccagaggtgacgccgcagccgccgggagccgcgagggacggggcaggatgaaccgggccaagcccaccacggtgcgccggcccagcgccgcggccaaaccctcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaagtgctgcccacggtgctgctggatgagatcgaggcggccgagctggagggcaacgatgacaggatcgagggcgtgctgtgcggggccgtgaagcagctgaaggtcacccgcgccaagcctgacagcaccctctacctgagcctcatgtacctggccaagatcaagcccaacatcttcgccactgagggcgtcattgaggctctgtgtagcctcctgcggcgggacgcctccatcaacttcaaggccaaggggaacagcctggtgtctgtgctggcctgtaacctcctcatggccgcctacgaggaggacgagaactggcccgagatctttgtcaaggtgtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaagttcctggccatggtgttccaggacctgctgaccaacaaggacgactacctgcgggcctcgcgggccctgctgcgggagatcatcaagcagaccaagcacgagatcaacttccaggccttctgcctggggctcatgcaggagcgcaaggagccgcagtacctggagatggagttcaaggagcgcttcgtggtgcacatcaccgacgtcctggccgtgtccatgatgctgggcatcacagcgcaggtgaaggaggccggcatcgcctgggacaaaggagaaaagaggaacctggaagtgctccgctcattccagaaccagattgccgccatccagcgggatgccgtctggtggctccacactgtggtcccctccatcagcaagctcgcccctaaggactacgtgcactgcctgcacaaggtgctgttcacagagcagccggagacctactacaagtgggacaactggccacccgagagtgaccgcaacttcttcctgcgtctgtgctccgaggtgcccattttggaggacacgctgatgcgcatcctggtcatcgggctgtcccgggagctcccgctcgggcctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccagggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtc

SEQ ID NO: 143092 - DNA, 386 bp, Homo sapiens
  Payload ID: 8276
  Gene Symbol: INTS1
  Gene Name: integrator complex subunit 1
  ENST ID: ENST00000483196
  CDS Start-End: 1-386
ctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggagggtgagtcaggccctgcttcacccacgccagatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccag

SEQ ID NO: 143093 - DNA, 2804 bp, Homo sapiens
  Payload ID: 8277
  Gene Symbol: INTS10
  Gene Name: integrator complex subunit 10
  Uniprot ID: Q9NVR2
  ENST ID: ENST00000397977
  CDS Start-End: 399-2531
aaactgagcaatacccagagaggatggaaatggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgggtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaagtttttaaaaa

SEQ ID NO: 143094 - DNA, 528 bp, Homo sapiens
  Payload ID: 8277
  Gene Symbol: INTS10
  Gene Name: integrator complex subunit 10
  ENST ID: ENST00000523869
  CDS Start-End: 1-164
gggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttatttgaaactcttcctggtcgggtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggtaagtaggaa

SEQ ID NO: 143095 - DNA, 572 bp, Homo sapiens
  Payload ID: 8277
  Gene Symbol: INTS10
  Gene Name: integrator complex subunit 10
  ENST ID: ENST00000521008
  CDS Start-End: 1-88
gtgctacatggtactccccattcaagatggaggcaaatcccaggaggaaccctcgaaagtaaagcccaaatttagaaaagggtcatgagtttcaaccagaaattttcttttttaatgagatagaattcaataatattttaagacgacatctcagacaagaagagagactgttattccatgcaccttttgttttggatctatcacattatgttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatca

SEQ ID NO: 143096 - DNA, 777 bp, Homo sapiens
  Payload ID: 8277
  Gene Symbol: INTS10
  Gene Name: integrator complex subunit 10
  ENST ID: ENST00000523772
  CDS Start-End: 1-521
gcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagccttctagccctcccatggggttactgcagcaggaattcttacctgtgcttcagcccagcatacagactgctgacaggcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaa

SEQ ID NO: 143097 - DNA, 631 bp, Homo sapiens
  Payload ID: 8277
  Gene Symbol: INTS10
  Gene Name: integrator complex subunit 10
  ENST ID: ENST00000520827
  CDS Start-End: 1-125
tgttgcttcagcaagagtggccacggggcgagaatcttttcctgaaagctgtcaataaaatttgccaacaaggaaatttccaatatgagaattttttcaattacgttacaacctgcagatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 143098 - DNA, 556 bp, Homo sapiens
  Payload ID: 8277
  Gene Symbol: INTS10
  Gene Name: integrator complex subunit 10
  ENST ID: ENST00000518424
  CDS Start-End: 148-348
actctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtgagtgggacgcttgacatcacttttactgcactgaatctctccatgaggttttgtttctctctgcagaagtgggagttgggggaagatcttcaagttcatctatatcttcgatacctaaagcaaacctagtttgtgaatttcccagaccagccggtggtgtggagagaaatcagcattattacatcagcattaaggaacgattcacagga

SEQ ID NO: 143099 - DNA, 623 bp, Homo sapiens
  Payload ID: 8277
  Gene Symbol: INTS10
  Gene Name: integrator complex subunit 10
  ENST ID: ENST00000520670
  CDS Start-End: 1-311
tgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaaggcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaagtttttaaaaatttaa

SEQ ID NO: 143100 - DNA, 457 bp, Homo sapiens
  Payload ID: 8277
  Gene Symbol: INTS10
  Gene Name: integrator complex subunit 10
  ENST ID: ENST00000518799
  CDS Start-End: 1-457
gagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaagatattgatatgctggaggaatttgcctacttgagaactcaggaaggtgggaaaattcatctggaattacta

SEQ ID NO: 143101 - DNA, 704 bp, Homo sapiens
  Payload ID: 8277
  Gene Symbol: INTS10
  Gene Name: integrator complex subunit 10
  ENST ID: ENST00000523846
  CDS Start-End: 1-704
aattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagagaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcag

SEQ ID NO: 143102 - DNA, 876 bp, Homo sapiens
  Payload ID: 8277
  Gene Symbol: INTS10
  Gene Name: integrator complex subunit 10
  ENST ID: ENST00000521357
  CDS Start-End: 1-149
tctgcagatacatgaacaactttgatagtgaagcacatgcaaaatataaaaaccaagtggtgtattccaccatgctggtcttctttaagaatgcattccagtatgtcaacagcatacagccatctctcttccaagagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttaca

SEQ ID NO: 143103 - DNA, 623 bp, Homo sapiens
  Payload ID: 8277
  Gene Symbol: INTS10
  Gene Name: integrator complex subunit 10
  ENST ID: ENST00000522114
  CDS Start-End: 102-299
ccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccaggagggccaacgagcgatgctggatgagctgggagccttctgggcaggggtgagtgaccagggtgcctgatgtgtgttgcagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgggtccagtgtgaaatgttactaaaggtcacggaacaatgcttcaacacgttagaacgatcagaaatgttgcttctacttttgaggcgcttccctgaaacggtggtgcagcatggg

SEQ ID NO: 143104 - DNA, 1710 bp, Homo sapiens
  Payload ID: 8278
  Gene Symbol: INTS12
  Gene Name: integrator complex subunit 12
  Uniprot ID: Q96CB8
  ENST ID: ENST00000340139
  CDS Start-End: 216-1604
agggaccaccgggaacagacggatcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 143105 - DNA, 1927 bp, Homo sapiens
  Payload ID: 8278
  Gene Symbol: INTS12
  Gene Name: integrator complex subunit 12
  Uniprot ID: Q96CB8
  ENST ID: ENST00000394735
  CDS Start-End: 433-1821
attggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggaactctgccagacaggggttacaacagtaggcaagaccaatccactgcctgccttcatggaacttacattctaatgagaaagaaagattatttacataattaacagtgtgattaatattacaaataagtacagaatgtttttgggctatgtaacagtgaaacttctagttttgttgagggaatgtgcaggaaaaactgaaacttgagaggtgacttaagatggaggtgggggtggcacactttctactgaagtgctaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 143106 - DNA, 995 bp, Homo sapiens
  Payload ID: 8278
  Gene Symbol: INTS12
  Gene Name: integrator complex subunit 12
  ENST ID: ENST00000416543
  CDS Start-End: 731-995
cggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggtatcagtgttatccagaaccaagaactcagtggaggaatgaaaaaggcagcatctttaaaataatgtttattggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaa

SEQ ID NO: 143107 - DNA, 562 bp, Homo sapiens
  Payload ID: 8278
  Gene Symbol: INTS12
  Gene Name: integrator complex subunit 12
  ENST ID: ENST00000433009
  CDS Start-End: 300-562
gaagggaccaccgggaacagacggatcggcagggcggggcggaacggtgtccctaaggtatcagtgttatccagaaccaagaactcagtggaggaatgaaaaaggcagcatctttaaaataatgtttattggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcac

SEQ ID NO: 143108 - DNA, 726 bp, Homo sapiens
  Payload ID: 8278
  Gene Symbol: INTS12
  Gene Name: integrator complex subunit 12
  ENST ID: ENST00000420368
  CDS Start-End: 332-726
atcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatatcaacacagttacaccaagttgctgacctctttatgactgctgtagaaagtaaacttctttcactatatggatatttgccggtaaggaaggaaaagtaacagagattagagaaggcaacagaaaagggggagtaaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgt

SEQ ID NO: 143109 - DNA, 1975 bp, Homo sapiens
  Payload ID: 8278
  Gene Symbol: INTS12
  Gene Name: integrator complex subunit 12
  Uniprot ID: Q96CB8
  ENST ID: ENST00000451321
  CDS Start-End: 481-1869
cgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 143110 - DNA, 569 bp, Homo sapiens
  Payload ID: 8278
  Gene Symbol: INTS12
  Gene Name: integrator complex subunit 12
  ENST ID: ENST00000515819
  CDS Start-End: 515-569
ggcagggcggggcggaacggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggcgtttgcaatggctgctactgtgaacttggaacttgatcccatttttttgaaagcactaggtt

SEQ ID NO: 143111 - DNA, 542 bp, Homo sapiens
  Payload ID: 8278
  Gene Symbol: INTS12
  Gene Name: integrator complex subunit 12
  ENST ID: ENST00000510876
  CDS Start-End: 371-542
agtcctaattcccgagccggggcgagtcgccctcggggggccgcggatggggtcccagactcgcaagggcgcgccctctccgcctcgggcgggcactcggagccgctggaccgctctcctcgcgccacgctgtgcggtggcccaacttctggatggaggagacgcctctctgaccacgaaaccccgcggggaaaagtgacccaagacagaagaagaccctcaccagatgccagccccttgatcttggacttcctagccttcagaaatgcatcaacgaaaggagagaaggaaaatttagaattacatgatttgaagaaacagtgtgcactttgtcctcatggtgtttgtaaattaagattcattttatataatggtaatgtcaaggcaatcgcaatctcaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgatt

SEQ ID NO: 143112 - DNA, 653 bp, Homo sapiens
  Payload ID: 8278
  Gene Symbol: INTS12
  Gene Name: integrator complex subunit 12
  ENST ID: ENST00000503746
  CDS Start-End: 176-653
agacggatcggcagggcggggcggaacgatcaacacagttacaccaagttgctgacctctttatgactgctgtagaaagtaaacttctttcactatatggatatttgccggtaaggaaggaaaagtaacagagattagagaaggcaacagaaaagggggagtaaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggat

SEQ ID NO: 143113 - DNA, 1502 bp, Homo sapiens
  Payload ID: 8278
  Gene Symbol: INTS12
  Gene Name: integrator complex subunit 12
  ENST ID: ENST00000618810
  CDS Start-End: 12-1346
aggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaaaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatc

SEQ ID NO: 143114 - DNA, 4255 bp, Homo sapiens
  Payload ID: 8279
  Gene Symbol: INTS2
  Gene Name: integrator complex subunit 2
  ENST ID: ENST00000251334
  CDS Start-End: 357-3947
cttcctctcagaccagtacggtggccgacgggagtcagacgctggggatgaatgaaggtgctgggtgcaggttgaaaaagtctcccgcttttccgttcctacagtcccggttctgcctttgtgtggtgcccccatccttcccactttgtatcgacaacccggttggtcccggcgtctgagttcttggtgtccgagtcgactcgaggcacaactagggtttggggttccggatatcgcctaggcccaacatcggaccgcgctctcgatttctgccgcgtcccgcctctaggacgcggagtccgtgtgcggttccgtgaggctggagggtagatcttaaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaataacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagctttt

SEQ ID NO: 143115 - DNA, 5878 bp, Homo sapiens
  Payload ID: 8279
  Gene Symbol: INTS2
  Gene Name: integrator complex subunit 2
  Uniprot ID: Q9H0H0
  ENST ID: ENST00000444766
  CDS Start-End: 77-3691
ctctgcctttcctctcgcagccacccttcctctcagaccagtacggtggccgacgggagtcagacgctggggatgaatgaaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaataacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaac

SEQ ID NO: 143116 - DNA, 411 bp, Homo sapiens
  Payload ID: 8279
  Gene Symbol: INTS2
  Gene Name: integrator complex subunit 2
  ENST ID: ENST00000583076
  CDS Start-End: 175-411
ctgctagtcggtcggccttgagaggggactgctttggctgccagctcactgcctttttgtttactttttgtgccttggatgattcctggagacagagaagtgcgctaatgagacgcgtctttctcacatagcacccacacatctgctttttacccggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattg

SEQ ID NO: 143117 - DNA, 5805 bp, Homo sapiens
  Payload ID: 8279
  Gene Symbol: INTS2
  Gene Name: integrator complex subunit 2
  Uniprot ID: Q9H0H0
  ENST ID: ENST00000617492
  CDS Start-End: 1-3615
atgaaagatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaataacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaa

SEQ ID NO: 143118 - DNA, 5235 bp, Homo sapiens
  Payload ID: 8280
  Gene Symbol: INTS3
  Gene Name: integrator complex subunit 3
  Uniprot ID: Q68E01
  ENST ID: ENST00000318967
  CDS Start-End: 569-3697
ccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccatagggacacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcttttgtgctggagtgtctgctggcatttgccccgtgcatgtatagcttggtcttgatttgattggcacccctacttgtaaccgcagaacatccccctttcccttcctgttctgcccccacttttgtctagagcagaagggacttggctttggccactacccatccttcctgctgccactggaggtgggagccaggcactgatctgtctatgcagaaccatcccccgtaggatgaggcctgtccttactcatttctcaagaaacaagatgcttccaaaaggtctgtcatcctccagttgaagtctgtgtgcctaccaagaatggccggaggactcgctgcttgacgggagggatgctccagcttggtctccagggacaactgtacctggagataaagtctggataccagggagggacagagatgctcttccttccacagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagca

SEQ ID NO: 143119 - DNA, 3597 bp, Homo sapiens
  Payload ID: 8280
  Gene Symbol: INTS3
  Gene Name: integrator complex subunit 3
  Uniprot ID: Q68E01
  ENST ID: ENST00000435409
  CDS Start-End: 204-3332
tggtgtggggagacgctggtcctccccgtcctcccatagcgcttattgcctcaccctcaccccctaggggccggatccaaaggcgctgcactccccaagccttggggcatcagccaggaagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgt

SEQ ID NO: 143120 - DNA, 1896 bp, Homo sapiens
  Payload ID: 8280
  Gene Symbol: INTS3
  Gene Name: integrator complex subunit 3
  ENST ID: ENST00000503133
  CDS Start-End: 1-148
tagtcagtctctgcgctgtgacctcattcgctacatctgtggggtagtccacccttctaatgaagtactgagttcagatatcttgccccggtgggccatcattggttggctcctgacaacgtgcacgacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttctt

SEQ ID NO: 143121 - DNA, 3442 bp, Homo sapiens
  Payload ID: 8280
  Gene Symbol: INTS3
  Gene Name: integrator complex subunit 3
  Uniprot ID: Q68E01
  ENST ID: ENST00000512605
  CDS Start-End: 276-2984
atttggcacttatctttataggcacttggaagagaaaattaggaagttgtccgtagcttagccagttgatagtccaagatagatactagcatgagtgagcaagcaaaaaatcaaagcatctactcccagtgtcaaatcatcaattatttctgaggcactgtagccaagcccaagaagcgtgaattgggagggtgaatagttctagacagagcataggagccagtgtgtttcctccctgcagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaactgtatgccttccaccctcggcgtccagtgtagacggtgctgccctggcccagactatgcctggagccaggctgggggcaggggcaggacacccggggccacaacccacactcgggataaaacaacctgtgcgtgctgtttaataagctcccagacatctgattgtttttccttccctgctctcccttttcttcctctagtttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctg

SEQ ID NO: 143122 - DNA, 3597 bp, Homo sapiens; identical to SEQ ID NO: 143119
  Payload ID: 8280
  Gene Symbol: INTS3
  Gene Name: integrator complex subunit 3
  Uniprot ID: Q68E01
  ENST ID: ENST00000571768
  CDS Start-End: 204-3332

SEQ ID NO: 143123 - DNA, 1896 bp, Homo sapiens; identical to SEQ ID NO: 143120
  Payload ID: 8280
  Gene Symbol: INTS3
  Gene Name: integrator complex subunit 3
  ENST ID: ENST00000575708
  CDS Start-End: 1-148

SEQ ID NO: 143124 - DNA, 3442 bp, Homo sapiens; identical to SEQ ID NO: 143121
  Payload ID: 8280
  Gene Symbol: INTS3
  Gene Name: integrator complex subunit 3
  Uniprot ID: Q68E01
  ENST ID: ENST00000576422
  CDS Start-End: 276-2984

SEQ ID NO: 143125 - DNA, 5235 bp, Homo sapiens; identical to SEQ ID NO: 143118
  Payload ID: 8280
  Gene Symbol: INTS3
  Gene Name: integrator complex subunit 3
  Uniprot ID: Q68E01
  ENST ID: ENST00000576030
  CDS Start-End: 569-3697

SEQ ID NO: 143126 - DNA, 478 bp, Homo sapiens
  Payload ID: 8280
  Gene Symbol: INTS3
  Gene Name: integrator complex subunit 3
  ENST ID: ENST00000623139
  CDS Start-End: 1-126
acacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagca

SEQ ID NO: 143127 - DNA, 3404 bp, Homo sapiens
  Payload ID: 8280
  Gene Symbol: INTS3
  Gene Name: integrator complex subunit 3
  ENST ID: ENST00000476843
  CDS Start-End: 1-843
gtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcgtgtaaaaagtattggctctacctcagactgctgggcatatgtcttcttggctcttagaggaatttctctcctgccatcgtattacaaagacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 143128 - DNA, 3404 bp, Homo sapiens; identical to SEQ ID NO: 143127
  Payload ID: 8280
  Gene Symbol: INTS3
  Gene Name: integrator complex subunit 3
  ENST ID: ENST00000575774
  CDS Start-End: 1-843

SEQ ID NO: 143129 - DNA, 478 bp, Homo sapiens; identical to SEQ ID NO: 143126
  Payload ID: 8280
  Gene Symbol: INTS3
  Gene Name: integrator complex subunit 3
  ENST ID: ENST00000624515
  CDS Start-End: 1-126

SEQ ID NO: 143130 - DNA, 3459 bp, Homo sapiens
  Payload ID: 8281
  Gene Symbol: INTS4
  Gene Name: integrator complex subunit 4
  ENST ID: ENST00000433818
  CDS Start-End: 29-427
cggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaacatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagagtcgaggtttcaccatggtggccaggctggtctcaaactcctgagctcaagtgatcctcccgcctcggcctcccaaagtgctggaattacaggcgtgagccactgtgcccggcctaggctcattctttcttctgtcttcatcttctgcatcaagcagcctctgcttaacaattcagatctaactgtgccccctgtattccatcctgtggggaaaaggaaacaggaagagaaaggcatctccttcttgatgtcaaagtccccaggaggcatcgttaactatcgtaacgttacctgccgagcatgagatgggaggaagtgtcatagtccagtggacggttttttccaggctactgtgaaacctgatgtgttatgccggccctgaaacagacagcttcccaagtgactcagaccttaagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 143131 - DNA, 1681 bp, Homo sapiens
  Payload ID: 8281
  Gene Symbol: INTS4
  Gene Name: integrator complex subunit 4
  ENST ID: ENST00000534408
  CDS Start-End: 11-301
gcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgagaatgatccatctgtgagactgaaaattgcatcattgttgggtttattatcaaagacagcaggattttcaccagactgcattatggatgatgccatcaacatcctgcagaatgaaatctcatcaagtcctagctcaactgctggatactttgcttgcaattggcactaagctaccagagaatcaagctatccaaatgcgattagttgatgtggcctgcaaggtaagagtataaaatctattcagatccatcctaaactggtaactgaggactgctaaggaccattaatggttttaggagctgccttatttttttcatctcttggtgttggattaggaataaagttaagtacacttgttataaagtgtatttcgtcatcctttcaaaacaaatgaaaataattacagtacatagttactgtgtatattgtgcctaataatgcactctgcttgttatggtgctttgtattcagtttttcatttggtcctcacaatccttcaagtaagtaccgttatttctcttttacaaaggtgaaaattaagatttatggagtctgatttgtctaagtttgcacagctaggaggttgcagtaccagggtataaactgtattttttctgaccccaaacttgttttgtttttattatgccttgttgcttcaataaacagaccaactatacacaagtaaatgtatgggaaaagttttgtacgttctttttttctgatttttaaatacatgtattaatacattaattgtgccttttgatttaatttggaggttaattagcctctttgtgtatacacagcaacccctagaaccctgtagaattgattttactttggatctttttgataactttgagaatataaaaaagtcaaatgcatttgaattgtgttagagtattatattcttgaaattagaaagctatctcagagatgcaggaaagattacttgatttatcttaaaacaacaggcatacataaaaccaaaaacactttgacaagtacaatactaaaagcttaaatagggccaggtgcggtggctcacacctataatcccagcactttgggaggcagaggtgggcggatcatttgacatcaggagtttgaaaccagcctgaccaacatggtgaaaccccatctctactaaaaatacaaaaaaaattagccgggcacggtgatgcctgcctgtaatcccagctactagggaggctgaggcaggagaatcgcttgaacctgcaagacggaggttatgtgagtggagattgagccactgcactccagtctgggtgatagagtgagactctgtctttaaaaaaaaaaacaaaaaa

SEQ ID NO: 143132 - DNA, 1845 bp, Homo sapiens
  Payload ID: 8281
  Gene Symbol: INTS4
  Gene Name: integrator complex subunit 4
  Uniprot ID: Q96HW7
  ENST ID: ENST00000529807
  CDS Start-End: 24-1541
gctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtaatgacttttttgcccatttactcactgagtcccataatgtggtaaatgtataatgctgacatttgttccgtccttatagattgaggatagtacggccctgaattttgcctttactttagaaacctgattcaacttaaccgaactctcaggaatctgattcctaagctgagtatcacattttagattacttactaatttgtgcatctatccacctagcaaatattatgtgcctgctgtgtgctgactatgcaccaacccttgtggtagctgttacaagtatagaaataaattaattagatttcctc

SEQ ID NO: 143133 - DNA, 3156 bp, Homo sapiens
  Payload ID: 8281
  Gene Symbol: INTS4
  Gene Name: integrator complex subunit 4
  Uniprot ID: Q96HW7
  ENST ID: ENST00000534064
  CDS Start-End: 36-2927
tagtgtacggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 143134 - DNA, 956 bp, Homo sapiens
  Payload ID: 8281
  Gene Symbol: INTS4
  Gene Name: integrator complex subunit 4
  ENST ID: ENST00000527522
  CDS Start-End: 28-318
ggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgtgagctaccacatctgaccaaaatcaggatttctgttctcaagaagttttcgatctctcagtgatctattttccgttagtctttttcttagcaatatctaccattattattatattaaagatctgttaccaataatcatctataataatacttcttagagcagttaacattatattgcttgttagagtttgaaagcactttccatatgtaatattttatttaatcctggtgacagcaccattgttatctctaaattccagatatggaactaagcttagagctgtttagtatccaaggtcacccagctagtaaatggaaggtatggatttgaacttgggttttttttttaaaaaaccttttgttatggaacatttcagatatatactatgtaagtaaagagaatagtttaattaattcccatgtacccattacctggcttcaaaaattatcattttgtggccaaacttgtttcattttccctcttccccaatccacttctacttctttaccctcaccttctccaccagattcttatgaaaataaattcctggcatcatattattttaatcataaattttgatttatat

SEQ ID NO: 143135 - DNA, 556 bp, Homo sapiens
  Payload ID: 8281
  Gene Symbol: INTS4
  Gene Name: integrator complex subunit 4
  ENST ID: ENST00000524766
  CDS Start-End: 23-313
ctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgtgagctaccacatctgaccaaaatcaggatttctgttctcaagaagttttcgatctctcagtgatctattttccgagaatgatccatctgtgagactgaaaattgcatcattgttgggtttattatcaaagacagcaggattttcaccagactgcattatggatgatgccatcaacatcctgcagaatgaaa

SEQ ID NO: 143136 - DNA, 1382 bp, Homo sapiens
  Payload ID: 8281
  Gene Symbol: INTS4
  Gene Name: integrator complex subunit 4
  Uniprot ID: Q96HW7
  ENST ID: ENST00000535943
  CDS Start-End: 139-1155
aggcatctccttcttgatgtcaaagtccccaggaggcatcgttaactatcgtaacgttacctgccgagcatgagatgggaggaagtgtcatagtccagtggacggttttttccaggctactgtgaaacctgatgtgttatgccggccctgaaacagacagcttcccaagtgactcagaccttaagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacacc

SEQ ID NO: 143137 - DNA, 3285 bp, Homo sapiens
  Payload ID: 8282
  Gene Symbol: INTS5
  Gene Name: integrator complex subunit 5
  Uniprot ID: Q6P9B9
  ENST ID: ENST00000330574
  CDS Start-End: 54-3113
atgcgccgcctgcgctccgccgctcgcgcctcgggctcggctcgggctccgggatgtccgcgctgtgcgaccctcccggggccccagggccacctgggcctgccccggccacccacggtcccgcgcctctcagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgctgtctgagtttatccgggccaacccaaaggcctgggcacctgtgattagtgcatggtccattgacctcatggggcaactgagcagcacgtactcaggccagcaccagcgtgttccccacgctactggcgctcttaatgaactgctacagctgtggatgggttgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagacaccgtgcgtgaggcttgtgaccggctaatccagctgctgctgctgcacctgcaaaaactggttcatcaccggggagggtctcctggggaaggggtgctaggcccgcccccacctccccgcttggtgccctttttagatgcgctcaaaaaccatgttggagagctgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaacca

SEQ ID NO: 143138 - DNA, 3662 bp, Homo sapiens
  Payload ID: 8283
  Gene Symbol: INTS6
  Gene Name: integrator complex subunit 6
  Uniprot ID: Q9UL03
  ENST ID: ENST00000311234
  CDS Start-End: 474-3137
gccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctatttta

SEQ ID NO: 143139 - DNA, 7041 bp, Homo sapiens
  Payload ID: 8283
  Gene Symbol: INTS6
  Gene Name: integrator complex subunit 6
  Uniprot ID: Q9UL03
  ENST ID: ENST00000398119
  CDS Start-End: 230-2854
agccggcctacaagcttcccccgcccctgagctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccgggacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctattttactcttgtgtggtttaggaaataatcacatttaaagtaatcatttaaaaacatcctaagataatggaattttaaaggccttgctttttagcattggaaaaatacaccacttgaagttcatgtttgttaagcctaactgtaattacatgttacataatctgcattgcctttttactatatgttcgtagtttttgttggccatgccaacatactcccatttctgcctagattatgggaatgactttgtatggggcagatagacagatactttaaaagctatttaaaaagcaaacaactttggatattattggtttccttacttcaacaccttttcctttatcactaggattgtggatggcacgaagctgaagctgttagggagtggtaggtttggagtacagtacatgctctgaaatatctagcctttagcagcttcatgccatgcttgcaaaagcccacaacaaattggaggcctccttgttctgctctgctgttctcacacttaaactctgttttatttataagctaaatggaaaggaaacacctttaagatgactttgctcattttgcatcccccctgagtttcacaggataaggaaaaccacgctattcattctccaccctcaattcaacatggcctagagtatccgtactgaggaagcaatcttatggcctgactcactcaccattcatgatcactgctgtgccttttagtggtttggggggtaagcagtagaaaagaaggtcaaaatagatttggattaagagtaggcaaaataaacttataacatttaaaaactgaagtatttttaggtttataatattgaaaatcacatacccttagctttttacactttatcagacatttttttaaatttcaagggtatagcaaaatgaaattataactttatgaagaaaagcattgatgaaagtggagaacatgcatttagtctaggggatttgaaactctcccaatactgaagacaaaccctgtcaagaaaaagaagaatttaatattatatagtattttcatatgcagttctttaagctttgtttacttctatacaaatacttttaagtaatgcaagataacatttaatagatggaattgttaaggtaattgcctgtagtcacattgctaaattcattgagagttacacaaaatccagaatatattgtctgttcctaaattatatatatttagattctggaattactaggaggaattagaagtcattcagataaaaattcatacttaacaagagtatctaggaaagagattcagcccatcccaatattgagcagctttccttatcagaaagttttattttctgtttcacagattgctcatgacctttaatacatttttctgaatgaaccctggagggaggtgagaagtagcagttttgttcatctcttctttttgtcctttatctctctgccactgttctcacctcatcctaaaacctggtcaggagggtttgaaacctatcagaactaaaggttaatatctcatctccctcaggcttttttcatttaaaaaaaaaatgggtatattagttaaattagaatacttgttgtagaattattgtcaaaggggaagggaaatacatctaggggaaacatcatgtcttttaggccctttatgtcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgtcctttttctcatctttcatttttttgacgtgtcctttctaagagaaggctctctgccgcctgttctgggtgataagtgatattttcatctaatcgttatgtggttgggatgatcatggtgaaatactaggaagacatactctgttgatggactttttctctccaaataatcccaaatagattattttctagtgaatggtttatatctttctcgtcacaaaaatgttcctttgatttctagcacaaggtacagcaggatgcaaatgattctcagataaaatgatgttgacagtatttccttaacaatttatgtaaaactatgcataattttcattctaacttttgacatttttctccataaataaaagtaatgcctgatgtttagttaaagtagatccacctttgcttgattttattagtcttgttctatcctatttctttttaatacactgtttagacttgccaacaactcttaactgagaatctcttttccttcctaggctaagtaattgtgagtgggggaggaagaacattaagagaaataatctaaagactttgttcaatattgtcgaagcctaagaatatttgtgtgtccttctgatgtactgaggctttgccggtaccacaccatctttggattaccataaggttatgtagtaggacttaaaagtactagggcaaacatttgatttttgagaaagatcaacagaacagtatagaaatccaggtgcattcattagaatactaggatcacaagaggactactctggtgtactctagtgacctgaaaaaactctaaaatgataagaaagctaggggacaaagggaaaaaagggcaagatttataatttattttactttcatgatttttccaagtgtcttcagaagtagaaacctatagcattaaaaaaaaaaatctacattaactatatatgagctgagagaatgagaaggtaaaaaacatggaggataagtttcctttgtacttacgaaatagtcccctttcttaggatagaagatagcaactgggtagcttctgaagcaccataaaaacagctagaaagaatgcttatttttgaggggatagtggacaaatgagcccttgttgctagagagacactgataaattatctgaatcctgtcaaaaaatactgtaatacctgtgttaggttctctcaggaaatagatgaatggccgatctgctttaaaaataggaatccgagaccttttcaataacaacagagctgcaggaaagaaagaaaaattccattgcattttctgtgcatttttaagaaaataactattggttatgaagtaagttaattttttaagaaatcaaagcatcctaatggcatttgattgtttactgttgtgatgggggtgcagatgggaaaattaaagagaaaagatgccatttagccaatcctgtctcctgttttcaacacattccatggaataaattccttattgaaggtaactttcagaatta
